(12) United States Patent
Aukerman et al.

(10) Patent No.: US 8,981,181 B2
(45) Date of Patent: Mar. 17, 2015

(54) MAIZE MICRORNA SEQUENCES

(75) Inventors: Milo Aukerman, Newark, DE (US); Hajime Sakai, Newark, DE (US); James Tisdall, Philadelphia, PA (US); Jeanne M. Wilson, Philadelphia, PA (US)

(73) Assignee: E. I. du Pont de Nemours and Company, Wilmington, DE (US)

( * ) Notice: Subject to any disclaimer, the term of this patent is extended or adjusted under 35 U.S.C. 154(b) by 0 days.

(21) Appl. No.: 12/963,135

(22) Filed: Dec. 8, 2010

(65) Prior Publication Data

US 2011/0083232 A1 Apr. 7, 2011

Related U.S. Application Data

(62) Division of application No. 11/868,081, filed on Oct. 5, 2007, now abandoned.

(60) Provisional application No. 60/849,672, filed on Oct. 5, 2006.

(51) Int. Cl.
*C12N 15/113* (2010.01)
*C12N 15/82* (2006.01)

(52) U.S. Cl.
CPC .......... *C12N 15/8218* (2013.01); *C12N 15/113* (2013.01); *C12N 2310/111* (2013.01); *C12N 2310/14* (2013.01); *C12N 2310/53* (2013.01)
USPC ........................ 800/285; 435/320.1; 536/24.5

(58) Field of Classification Search
None
See application file for complete search history.

(56) References Cited

U.S. PATENT DOCUMENTS

2009/0093620 A1* 4/2009 Kovalic et al. ................ 536/23.1
2009/0293148 A1* 11/2009 Ren et al. ...................... 800/279

OTHER PUBLICATIONS

Schwab et al. (2006) Plant Cell 18: 1121-1133.*
Friedrich et al. (1982) J. Agric. Food Chem. 30: 192-193.*
Ishida et al. (1996) Nature Biotechnol. 14: 745-750.*
Whiteclaw et al. (2002) GenBank Accession No. BZ720359.*
TOPO TA Cloning Kit for Sequence (Invitrogen Life Technologies, copyright 2000-2002, version J, pp. 1-30).*
U.S. Appl. No. 10/963,238, filed Oct. 12, 2004, E. I. du Pont de Nemours and Company.
U.S. Appl. No. 10/963,394, filed Oct. 12, 2004, E. I. du Pont de Nemours and Company.
U.S. Appl. No. 10/833,374, filed Jul. 1, 2004, Patrick Lad et al.
U.S. Appl. No. 10/913,288, filed Aug. 6, 2004, Whitehead Institute for Biomedical Research.
U.S. Appl. No. 11/334,776, filed Jan. 6, 2006, State of Oregon.
Allen et al., Microrna-Directed Phasing During Trans-Acting Sirna Biogenesis in Plants, Cell, 2005, vol. 121:207-221.
Allshire et al., RNAI and Heterochromatin—A Hushed-Up Affair, Science, 2002, vol. 297:1818-1819.
Aukerman et al., Regulation of Flowering Time and Floral Organ Identity by a Microrna and Its APETALA2-Like Target Genes, Plant Cell, 2003, vol. 15:2730-2741.
Axtell et al., Antiquity of Micrornas and Their Targets in Land Plants, Plant Cell 2005, vol. 17:1658-1673.
Bartel., Mcirornas: Genomics, Biogenesis, Mechanism, and Function, Cell 2004, vol. 116:281-297.
Berstein et al., Role for Bidentate Ribonuclease in the Initiation Step of RNA Interface, Nature, 2001, vol. 409:363-366.
Bonnet et al., Tansley Review: The Small RNA World of Plants, New Phytol., 2006, vol. 171:451-468.
Buchman et al., Comparison of Intron-Dependent and Intron-Independent Gene Expression, Mol. Cell Biol., 1988, vol. 8:4395-4405.
Call Is et al., Introns Increase Gene Expression in Cultured Maize Cells, Genes Dev., 1987, vol. 1:1183-1200.
Database EMBL, Aug. 28, 2003, PUKA075TB *Zea mays* genomic clone ZMMBTa0775N05, genomic survey sequence, Database Accession No. CG111078.
Davison et al., Analyzing Micro-RNA Expression Using Microarrays, Methods in Enzymology, 2006, vol. 411:14-34.
Elbashir et al., Duplexes F 21-Nucleotide RNAS Mediate RNA Interference in Cultured Mammalian Cells, Nature, 2001, vol. 411:494-498.
Elbashir et al., RNA Interference is Mediated by 21- and 22-Nucleotide RNAS, Genes Dev., 2001, vol. 15:18B.
Fire et al., Potent and Specific Genetic Interference by Double-Stranded RNA in *Caenorhabditis elegans*, Nature, 1998, vol. 391:806-611.
Fire et al., RNA-Triggered Gene Silencing, Trends Genet., 1999, vol. 15:358-363.
Griffiths-Jones, Mirbase: Microrna Sequences, Targets and Gene Nomenclature, Nuc. Acids. Res., 2006, vol. 34:140-144.
Grishok et al., Genes and Mechanisms Related to RNA Interference Regulate Expression of the Small Temporal RNAS That Control *C. elegans* Developmental Timing, Cell, 2001, vol. 106:23-34.
Hall et al.. Establishment and Maintenance of a Heterochromatin Domain, Science, 2002, vol. 297:2232-2237.
Hammond et al., An RNA-Directed Nuclease Mediates Post-Transcriptional Gene Silencing in *Drosophila* Cells, Nature, 2000, vol. 404:293-296.
Hutvagner et al., A Cellular Function for the RNA-Interference Enzyme Dicer in the Maturation of the Let-7 Small Temporal RNA, Science, 2001, vol. 293:834-838.
Hutvagner et al., A Microrna in a Multiple-Turnover RNAI Enzyme Complex, Science, 2002, vol. 297:2056-2060.
Jenuwein et al., An RNA-Guided Pathway for the Epigenome, Science, 2002, vol. 297:2215-2218.
Johnson et al., CSRDB: A Small RNA Integrated Database and Browser Resource for Cereals, Nuc. Acids Res., 2007, vol. 35:829-833.
Jones-Rhoades et al., Computational Identification of Plant Micrornas and Their Targets, Including a Stress-Induced Mirna, Mol. Cell, 2004, vol. 14:787-799.

(Continued)

*Primary Examiner* — David T Fox
*Assistant Examiner* — Steven Bernacki

(57) ABSTRACT

Methods and compositions useful in target sequence suppression and target sequence validation are described. Polynucleotide constructs useful for gene silencing, as well as cells, plants and seeds comprising the polynucleotides and a method for using microRNAs to silence a target sequence are also described.

4 Claims, No Drawings

(56) References Cited

OTHER PUBLICATIONS

Ketting et al., Dicer Functions in RNA Interference and in Synthesis of Small RNA Involved in Developmental Timing in *C. elegans*, Genes Dev., 2001, vol. 15:2654-2659.

Kurihara et al., Arabidopsis Micro-RNA Biogenesis Through Dicer-Like 1 Protein Functions, Proc. Natl. Acad. Sci., 2004, vol. 101:12753-12758.

Lagos-Quintana et al., Identification of Novel Genes Coding for Small Expressed RNAS, Science, 2001, vol. 294:853-858.

Lagos-Quintana et al., Identification of Tissue-Specific Micrornas From Mouse, Curr. Biol., 2002, vol. 12:735.739.

Lau et al., An Abundant Class of Tiny RNAS With Probable Regulatory Roles in *Caenorhabditis elegans*, Science, 2001, vol. 294:858-862.

Lee et al., An Extensive Class of Small RNAS in *Caenorhabditis elegans*, Science, 2001, vol. 294:862-864.

Lee et al., Microrna Maturation: Stepwise Processing and Subcellular Localization, Embo J., 2002, vol. 21:4663-4670.

Lee et al., The *C. elegans* Heterochronic Gene Lin-4 Encodes Small RNAS With Antisense Complementarity to Lin-14, Cell, 1993, vol. 75:843-854.

Llave et al., Cleavage of Scarecrow-Like MRNA Targets Directed by a Class of *Arabidopsis*, Science, vol. 297:2053-2056.

Llave et al., Endogenous and Silencing-Associated Small RNAS in Plants, Plant Cell, 2002, vol. 14:1605-1619.

Luck, Normalization and Error Estimation for Biomolecular Expression Patterns, Proceedings of SPIE, 2001, vol. 4266:153-157.

Mallory et al., Functions of Micrornas and Related Small RNAS in Plants, Natl. Genet., 2006, vol. 38:31-36.

Meyers et al, Sweating the Small Stuff: Microrna Discovery in Plants, Curr. Opin. Biotech., 2006, vol. 17:1-8.

Mica Erica at al., Characterization of five microRNA families in maize, Journal of Experimental Botany. vol. 57(11), pp. 2601-2612, 2006.

Mourelatos et al., MIRNPS: A Novel Class of Ribonucleoproteins Containing Numerous Micrornas, Genes Dev., 2002, vol, 16:720-728.

Parizotto et al., In Vitro Investigation of the Transcription, Processing, Endonucleolytic Activity, and Functional Relevance of the Spatial Distribution of a Plant Mirna, Genes Dev., 2004, vol. 18:2237-2242.

Park et al., Carpel Factory, A Dicer Homolog, and Hens, A Novel Protein, Act in Microrna Metabolism in *Arabidopsis thaliana*, Curr. Biol., 2002, vol, 12:1484-1495.

Reinhart et al., Micrornas in Plants, Genes Dev., 2002, vol. 16:1616-1626.

Reinhart et al., The 21-Nucleotide Let-7 RNA Regulates Developmental Timing in *Caenorhabditis*, Nature, 2000, vol. 403:901-906.

Rhoaides et al., Prediction of Plant Microrna Targets, Cell, 2002, vol. 110:513-620.

Schwartz et al., Asymmetry in the Assembly of the RNAI Enzyme Complex, Cell, 2003, vol. 115:199-208.

Shi et al., Facile Means for Quantifying Microrna Expression by Real-Time PCR, Biotechniques, 2005, vol. 39:519-525.

Slack et al., The Lin-41 RBCC Gene Acts in the *C. elegans* Heterochronic Pathway Between the Let-7 Regulatory RNA and the Lin-29 Transcription Factor, Mol. Cell, 2000, vol. 5:659-669.

Sunkar et al., Cloning and Characterization of Micrornas From Rice, The Plant Cell, 2005, vol. 17:1397-1411.

Sunkar et al., Novel and Stress-Regulated Micrornaa and Other Small RNAS From *Arabidopsis*, Plant Cell, 2004, vol. 16:2001-2019.

Van Eenennaam et al., Plant Cell, 2003, vol. 15, p. 3007-3019.

Volpe et al., Regulation of Heterochromatic Silencing and Histone H3 Lysine-9 Methylation by RNA1, Science, 2002, vol. 297:1833-1837.

Wianny et al., Specific Interference With Gene Function by Double-Stranded RNA in Early Mouse Development, Nature Cell Biol., 1999, vol. 2:70-75.

Wightman et al., Posttranscriptional Regulation of the Heterochronic Gene Lin-14 by Lin-4 Mediates Temporal Pattern Formation in *C. elegans*, Cell, 1993, vol. 75:855-862.

Zhang et al., Identification of 188 Conserved Maize RNAS and Their Targets, FEBS Lett., 2006, vol. 580:3753-3762.

Database EMBL [Online] Mar. 19, 2003,"PUGFE74TD ZM 0.6_1.0_KB *Zea mays* genomic clone ZMMBTA370NO3, DNA Sequence.", XP002712519, retrieved from EBI Accession No. EM_GSS:BZ786669 Database Accession No. BZ786669.

Database EMBL [Online] Jul. 19, 2004, "3530_1_203_1_E05.y_1 3530—Full length cDNA library created by Invitrogen from multiple tissues *Zea mays* cDNA, mRNA Sequence"., XP002712520, retrieved from EBI Accession No. EM_EST:C0530846, Database Accession No. C0530846.

Corresponding European Search Report on Application No. 13162637.6, Dated Jan. 22, 2014.

Juarez, M.T., et al., "microRNA-mediated repression of *rolled leafl* species maize leaf polarity," *Nature*, vol. 428, pp. 84-88 (Mar. 2004).

Lauter, N., et al., "*microRNA172* down-regulates *glossy15* to promote vegetative phase change in maize," *PNAS*, vol. 102, No. 26, pp. 9412-9417 (Jun. 2005).

\* cited by examiner

MAIZE MICRORNA SEQUENCES

CROSS REFERENCE TO RELATED APPLICATIONS

This is a divisional application of U.S. Utility application Ser. No. 11/868,081 filed Oct. 5, 2007, which claims the benefit of U.S. Provisional Application No. 60/849,672, filed Oct. 5, 2006, both of which are herein incorporated by reference in their entirety.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named 399455SEQLIST.txt, created on Dec. 8, 2010, and having a size of 1,560 kilobytes and is filed concurrently with the specification. The sequence listing contained in this ASCII formatted document is part of the specification and is herein incorporated by reference in its entirety.

FIELD OF THE INVENTION

The field of the present invention relates generally to plant molecular biology. More specifically it relates to constructs and methods to suppress the expression of targeted genes.

BACKGROUND

MicroRNAs (miRNAs) were first identified only a few years ago, but already it is clear that they play an important role in regulating gene activity. These 20-22 nucleotide non-coding RNAs have the ability to hybridize via base-pairing with specific target mRNAs and downregulate the expression of these transcripts, by mediating either RNA cleavage or translational repression. Recent studies have indicated that miRNAs have important functions during development. In plants, they have been shown to control a variety of developmental processes including flowering time, leaf morphology, organ polarity, floral morphology, and root development (reviewed by Mallory and Vaucheret (2006) *Nat Genet* 38: S31-36). Given the established regulatory role of miRNAs, it is likely that they are also involved in the control of some of the major crop traits such drought tolerance and disease resistance.

Plant miRNAs are processed from longer precursor transcripts termed pre-miRNA that range in length from ~50 to 500 nucleotides, and these precursors have the ability to form stable hairpin structures (reviewed by Bartel (2004) *Cell* 116: 281-297). Many miRNA hairpin precursors originate as longer transcripts of 1-2 kb or longer, termed pri-miRNA, that are polyadenylated and capped. This fact coupled with the detection of numerous pri-miRNAs in Expressed Sequence Tags (ESTs) libraries indicates that RNA polymerase II is the enzyme responsible for miRNA gene transcription. Transgenic experiments indicate that it is the structure rather than the sequence of the pre-miRNA that directs their correct processing and that the rest of the pri-miRNA is not required for the production of miRNAs. While pri-miRNAs are processed to pre-miRNAs by Drosha in the nucleus and Dicer cleaves pre-miRNAs in the cytoplasm in metazoans, miRNA maturation in plants differs from the pathway in animals because plants lack a Drosha homolog. Instead, the RNase III enzyme DICER-LIKE 1 (DCL1), which is homologous to animal Dicer, may possess Drosha function in addition to its known function in hairpin processing (Kurihara and Watanabe (2004) *Proc Natl Acad Sci* 101: 12753-12758).

Through the cloning efforts of several labs, at least 30 miRNA families have been identified in *Arabidopsis* (reviewed by Meyers et al. (2006) *Curr Opin Biotech* 17; 1-8). Many of these miRNA sequences are represented by more than one locus, bringing the total number up to approximately 100. Because the particular miRNAs found by one lab are not generally overlapping with those found by another independent lab, it is assumed that the search for the entire set of miRNAs expressed by a given plant genome, the "miR-Nome," is not yet complete. One reason for this might be that many miRNAs are expressed only under very specific conditions, and thus may have been missed by standard cloning efforts. A recent study by Sunkar and Zhu (2004, *Plant Cell* 16: 2001-2019) suggests that, indeed, miRNA discovery may be facilitated by choosing "non-standard" growth conditions for library construction. Sunkar and Zhu identified novel miRNAs in a library consisting of a variety of stress-induced tissues. They proceeded to demonstrate induction of some of these miRNAs by drought, cold and other stresses, suggesting a role for miRNAs in stress response. It is likely, then, that efforts to fully characterize the plant miRNome will require examination of the small RNA profile in many different tissues and under many different conditions.

A complementary approach to standard miRNA cloning is computational prediction of miRNAs using available genomic and/or EST sequences, and several labs have reported finding novel *Arabidopsis* miRNAs in this manner (reviewed by Bonnet et al. (2006) *New Phytol* 171:451-468). Using these computational approaches, which rely in part on the observation that known miRNAs reside in hairpin precursors, hundreds of plant miRNAs have been predicted. However only a small fraction have been experimentally verified by Northern blot analysis. In addition, most of these computational methods rely on comparisons between two representative genomes (e.g. *Arabidopsis* and rice) in order to find conserved intergenic regions, and thus are not suitable for identifying species-specific miRNAs, which may represent a substantial fraction of the miRNome of any given organism.

Computational methods have also facilitated the prediction of miRNA targets, and in general plant miRNAs share a high degree of complementarity with their targets (reviewed by Bonnet et al. (2006) *New Phytol* 171:451-468). The predicted mRNA targets of plant miRNAs encode a wide variety of proteins. Many of these proteins are transcription factors and are thus likely to be important for development. However, there are also many enzymes that are putatively targeted, and these potentially have roles in such processes as mitochondrial metabolism, oxidative stress response, proteasome function, and lignification. It is likely that this list of processes regulated by miRNA will get longer as additional miRNAs are identified, and that eventually miRNAs will be implicated in processes critical to crop improvement. For example, a recently identified miRNA targeting genes in the sulfur assimilation pathway was identified, and shown to be induced under conditions of sulfate starvation (Jones-Rhoades and Bartel (2004) *Mol Cell* 14: 787-799). This particular miRNA, then, is a candidate gene for increasing sulfur assimilation efficiency. It is tempting to speculate that the pathways for assimilating other compounds such as water and nitrate may also be under miRNA control.

Much of the work on identification of novel miRNAs has been carried out in the model system *Arabidopsis*, and thus miRNomes of crop plants such as maize, rice and soybean are less fully understood. There is also no complete genome sequence available for crops such as maize and soybeans, further hampering miRNome analysis. Many *Arabidopsis* miRNAs have homologs in these other species, however there are also miRNAs that appear to be specific to *Arabidopsis*. Likewise, it is expected that there will be nonconserved miRNAs specific to the aforementioned crop species. A significant fraction of the non-conserved miRNAs could be part of the regulatory networks associated with species-specific growth conditions or developmental processes. As such, it is crucial to carry out miRNA cloning in crop species such as maize, to complement the bioinformatic approaches currently being used, and ultimately to more fully characterize the miRNomes of crop species.

BRIEF DESCRIPTION OF THE TABLES

TABLE 1

The table of putative miRNAs consists of 2808 rows of 6 columns, which are

1: ID: a unique ID number, which represents the SEQ ID NO for the corresponding microRNA (miRNA) in that row
2: miRNA: the 21 nucleotide maize microRNA sequence
3: TARGETSEQ: the exact complement of the miRNA that corresponds to one potential site for cleavage on the target mRNA
4: BACKBONE: the genomic DNA sequence that forms a hairpin structure incorporating the miRNA sequence
5: FOLD: secondary structure information for the backbone sequences based on context free grammar of nested parentheses, where a "(" represents a nucleotide that hybridizes with a down stream nucleotide denoted by a ")", and a "." represents an unpaired nucleotide the resulting structure displays the hairpin structure formed by the backbone
6: TARGET: public ID(s) of possible genomic targets of the miRNA, databases that were searched included rice genes from the TIGR Version 4 rice datasets all.cds and all_small_genes.cds; and the TIGR maize gene index file ZMGI.101205.

TABLE 4

The table of small RNA expression data for maize microRNAs of the present invention and public domain *Zea mays* microRNAs consists of 2702 rows of 18 columns, which are 1: ID: a unique ID number, which represents the SEQ ID NO for the corresponding putative microRNA (miRNA) in that row, or the public domain *Zea mays* names associated with the miRNA sequence in that row
2: MIRNACORE: the ~21 nucleotide maize microRNA sequence, also referred to as the "query sequence"
3. CALL B73_LEAF: the detectability assessment applied to the miRNA in that row based on its corresponding expression profiling measurements in RNA samples derived from B73 leaf tissue. "PASSED," "ENRICHED" or "HIGHLY ENRICHED" were applied only if the array data for that miRNA met the specificity, reproducibility and signal strength criteria in Table 3. "ENRICHED" was applied to miRNAs showing between 5-fold and 10-fold more perfectly sequence matched (0 MM) probe signal intensity in B73 leaf samples than in other samples in the same experiment. "HIGHLY ENRICHED" was applied to miRNAs showing 10-fold more 0 MM-probe signal intensity in B73 leaf samples than in other samples in the same experiment. Sample B73 Leaf and all other samples are described in Table 2
4. 0 MM B73_LEAF: the normalized fluorescence intensity score of the perfectly sequence matched probe of the miRNA in that row as measured in expression profiling of genotype B73 leaf RNA.
5. CALL B73_EAR: the detectability assessment applied to the miRNA in that row based on its corresponding expression profiling measurements in RNA samples derived from B73 ear tissue.
6. 0 MM B73_EAR: the normalized fluorescence intensity score of the perfectly sequence matched probe of the miRNA in that row as measured in expression profiling of genotype B73 ear RNA.
7. CALL B73_SEEDLING: the detectability assessment applied to the miRNA in that row based on its corresponding expression profiling measurements in RNA samples derived from B73 seedling tissue.
8. 0 MM B73_SEEDLING: the normalized fluorescence intensity score of the perfectly sequence matched probe of the miRNA in that row as TABLE 4-continued The table of small RNA expression data for maize microRNAs of the present invention and public domain *Zea mays* microRNAs consists of 2702 rows of 18 columns, which are measured in expression profiling of genotype B73 seedling RNA.
9. CALL 3245_Normal_N: the detectability assessment applied to the miRNA in that row based on its corresponding expression profiling measurements in RNA samples derived from 3245 leaf tissue grown in fields with normal levels of nitrogen.
10. 0 MM 3245_Normal_N: the normalized fluorescence intensity score of the perfectly sequence matched probe of the miRNA in that row as measured in expression profiling of RNA from leaves of genotype 3245 plants grown in fields with normal levels of nitrogen.
11. CALL 3245_Low_N: the detectability assessment applied to the miRNA in that row based on its corresponding expression profiling measurements in RNA samples derived from 3245 leaf tissue grown in fields with low levels of nitrogen.
12. 0 MM 3245_Low_N: the normalized fluorescence intensity score of the perfectly sequence matched probe of the miRNA in that row as measured in expression profiling of RNA from leaves of genotype 3245 plants grown in fields with low levels of nitrogen.
13. CALL 33B50_Low_N: the detectability assessment applied to the miRNA in that row based on its corresponding expression profiling measurements in RNA samples derived from 33B50 leaf tissue grown in fields with low levels of nitrogen.
14. 0 MM 33B50_Low_N: the normalized fluorescence intensity score of the perfectly sequence matched probe of the miRNA in that row as measured in expression profiling of RNA from leaves of genotype 33B50 plants grown in fields with low levels of nitrogen.
15. CALL B73_Low_N: the detectability assessment applied to the miRNA in that row based on its corresponding expression profiling measurements in RNA samples derived from B73 leaf tissue grown with minimal nitrogen supplementation.
16. 0 MM B73_Low_N: the normalized fluorescence intensity score of the perfectly sequence matched probe of the miRNA in that row as measured in expression profiling of RNA from leaves of genotype B73 plants grown with minimal nitrogen supplementation.
17: TARGETSEQ: the exact complement of the miRNA that corresponds to one potential site for cleavage on the target mRNA
18: TARGET: public ID(s) of possible genomic targets of the putative miRNA, databases that were searched included rice genes from the TIGR Version 4 rice datasets all.cds and all_small_genes.cds; and the TIGR maize gene index file ZMGI.101205.

BRIEF DESCRIPTION OF THE SEQUENCE LISTING

A Sequence Listing and Table are provided herewith on Compact Disk. The contents of the Compact Disk containing the Sequence Listing and Table are hereby incorporated by reference in compliance with 37 CFR 1.52(e). The Compact Disks are submitted in triplicate and are identical to one another. The disks are labeled "Copy 1—Sequence Listing and Table", "Copy 2—Sequence Listing and Table", and CRF. The disks contain the following files: BB1593 US PRV Sequence Listing having the following size: 1,471,000 bytes and BB1593 US PRV Table having the following size: 4,430,000 bytes which were created Oct. 5, 2006.

SEQ ID NOs: 1-2652 represent individual 21 nucleotide microRNA sequences from maize. The individual microRNAs are shown in Table 1 as the "miRNAcore" column (column 2), the SEQ ID NO for each sequence is shown in column 1 (ID) of Table 1.

SEQ ID NOs: 2653-5304 represent the complement of SEQ ID NOs:1-2652, also shown as "targetseq" in column 3 of Table 1.

SEQ ID NOs:5305-7956 represent the "backbone" hairpin sequence that surrounds the miRNAs in SEQ ID NOs:1-2652, respectively, in the maize genome. This information can also be found in column 4 of Table 1.

SEQ ID NO:7957 is a sequential concatenation of all 21 nucleotide miRNAs found in SEQ ID NOs:1-2652

(21×2652=55,692). It is believed that this representative example is one of many different forms that are useful for altering plant gene expression. Other examples would include different ordering of the individual miRNA sequences, duplication of certain miRNA sequences, elimination of certain miRNA sequences, and altered spacing in between the miRNA sequences.

SEQ ID NO:7958 is a 21 nucleotide sequence complementary to the *Arabidopsis* fatty acid desaturase 2 (FAD2) gene.

SEQ ID NOs: 7959-8114 represent individual 21 nucleotide microRNA sequences from maize. The individual microRNAs are shown in Table 1 as the "miRNAcore" column (column 2), the SEQ ID NO for each sequence is shown in column 1 (ID) of Table 1.

SEQ ID NOs: 8115-8270 represent the complement of SEQ ID NOs:7959-8114, also shown as "targetseq" in column 3 of Table 1.

SEQ ID NOs:8271-8426 represent the "backbone" hairpin sequence that surrounds the miRNAs in SEQ ID NOs:7959-8114, respectively, in the maize genome. This information can also be found in column 4 of Table 1.

SEQ ID NO:8427 is a sequential concatenation of all 21 nucleotide miRNAs found in SEQ ID NOs:7959-8114 (21× 156=3,276). It is believed that this representative example is one of many different forms that are useful for altering plant gene expression. Other examples would include different ordering of the individual miRNA sequences, duplication of certain miRNA sequences, elimination of certain miRNA sequences, and altered spacing in between the miRNA sequences.

SEQ ID NOs:8428-8429 are RNA adaptors sequences.

SUMMARY OF THE INVENTION

The present invention relates, inter alia, to an isolated polynucleotide comprising: a microRNA selected from the group consisting of SEQ ID NOs:1-2652 and SEQ ID NOs:7959-8114.

In a second embodiment, the invention relates to a full-length complement of the microRNA selected from the group consisting of SEQ ID NOs:1-2652 and SEQ ID NOs:7959-8114 or a nucleotide sequence capable of hybridizing to these aforemention microRNAs. wherein the hybridizable nucleotide sequence comprises at least 21 nucleotides.

In a third embodiment, the invention relates to an isolated polynucleotide useful for altering plant gene expression comprising SEQ ID NO:7957 or SEQ ID NO:8427 wherein said isolated polynucleotide comprises at least one functional domain having at least 21(x) contiguous nucleotides and x is an integer from 1 to 2652, further wherein said nucleotides start at nucleotide 1 or any nucleotide 21(x)+1.

In a fourth embodiment, the invention relates to a functional subdomain of such isolated polynucleotides, wherein said functional subdomain comprises at least one microRNA.

In a fifth embodiment, the invention relates to an isolated polynucleotide comprising a microRNA containing sequence selected from the group consisting of SEQ ID NOs: 5305-7956 and SEQ ID NOs:8271-8426.

In a sixth embodiment, the invention relates to a DNA expression construct comprising any of the isolated polynucleotides discussed herein operably linked to at least one regulatory sequence.

In a seventh embodiment, the invention relates to a plant comprising in its genome the DNA expression constructs discussed herein. Such plants can be selected from the group consisting of corn, rice, sorghum, sunflower, millet, soybean, canola, wheat, barley, oat, beans, and nuts.

In an eighth embodiment, the invention relates to transgenic seeds obtained from a plant comprising in its genome the DNA expression constructs discussed herein. Also within the scope of the invention are transformed plant tissue or a plant cell comprising in its genome the DNA expression constructs discussed herein.

In an ninth embodiment, the invention relates to by-products obtained from such transgenic seeds or to progeny plants obtained from such transgenic seeds.

In a tenth embodiment, the invention relates to a method for altering expression of a stably introduced nucleotide sequence in a plant comprising:
a) making a DNA expression construct comprising a stably introduced nucleotide sequence and at least one sequence capable of hybridizing to the isolated polynucleotide of the invention;
b) transforming a plant with the DNA expression construct of part (a); and
c) selecting a transformed plant which comprises the DNA expression construct of part (a) in its genome and which has altered expression of the stably introduced nucleotide sequence when compared to a plant transformed with a modified version of the DNA expression construct of part (a) wherein the modified construct lacks the sequence capable of hybridizing to the isolated polynucleotide of the invention.

DETAILED DESCRIPTION

Information pertinent to this application can be found in U.S. patent application Ser. Nos. 10/963,238 and 10/963,394, filed Oct. 12, 2004. The entire contents of the above applications are herein incorporated by reference.

Other references that may be useful in understanding the invention include U.S. patent application Ser. No. 10/883, 374, filed Jul. 1, 2004; U.S. patent application Ser. No. 10/913,288, filed Aug. 6, 2004; and U.S. patent application Ser. No. 11/334,776, filed Jan. 6, 2006.

Recently discovered small RNAs play an important role in controlling gene expression. Regulation of many developmental processes including flowering is controlled by small RNAs. It is now possible to engineer changes in gene expression of plant genes by using transgenic constructs which produce small RNAs in the plant.

The invention provides methods and compositions useful for suppressing targeted sequences. The compositions can be employed in any type of plant cell, and in other cells which comprise the appropriate processing components (e.g., RNA interference components), including invertebrate and vertebrate animal cells. The compositions and methods are based on an endogenous miRNA silencing process discovered in *Arabidopsis*, a similar strategy can be used to extend the number of compositions and the organisms in which the methods are used. The methods can be adapted to work in any eukaryotic cell system. Additionally, the compositions and methods described herein can be used in individual cells, cells or tissue in culture, or in vivo in organisms, or in organs or other portions of organisms.

The compositions selectively suppress the target sequence by encoding a miRNA having substantial complementarity to a region of the target sequence. The miRNA is provided in a nucleic acid construct which, when transcribed into RNA, is predicted to form a hairpin structure which is processed by the cell to generate the miRNA, which then suppresses expression of the target sequence.

Nucleic acid sequences are disclosed that encode miRNAs from maize. Backbone hairpins containing the individual miRNA sequences are also disclosed. Constructs are described for transgenic expression of miRNAs and their backbones. Alternatively, constructs are described wherein backbone sequences and miRNA sequences are exchanged thereby altering the expression pattern of the miRNA, and its subsequent specific target sequence in the transgenic host. Any miRNA can be exchanged with any other backbone to create a new miRNA/backbone hybrid.

A method for suppressing a target sequence is provided. The method employs any of the constructs above, in which a miRNA is designed to identify a region of the target sequence, and inserted into the construct. Upon introduction into a cell, the miRNA produced suppresses expression of the targeted sequence. The target sequence can be an endogenous plant sequence, or a heterologous transgene in the plant.

There can also be mentioned as the target gene, for example, a gene from a plant pathogen, such as a pathogenic virus, nematode, insect, or mold or fungus.

Another aspect of the invention concerns a plant, cell, and seed comprising the construct and/or the miRNA. Typically, the cell will be a cell from a plant, but other prokaryotic or eukaryotic cells are also contemplated, including but not limited to viral, bacterial, yeast, insect, nematode, or animal cells. Plant cells include cells from monocots and dicots. The invention also provides plants and seeds comprising the construct and/or the miRNA.

"Plant" includes reference to whole plants, plant organs, plant tissues, seeds and plant cells and progeny of same. Plant cells include, without limitation, cells from seeds, suspension cultures, embryos, meristematic regions, callus tissue, leaves, roots, shoots, gametophytes, sporophytes, pollen, and microspores.

The term "plant parts" includes differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or group of tissues that constitute a morphologically and functionally distinct part of a plant.

The term "genome" refers to the following: (1) the entire complement of genetic material (genes and non-coding sequences) present in each cell of an organism, or virus or organelle; (2) a complete set of chromosomes inherited as a (haploid) unit from one parent.

"Progeny" comprises any subsequent generation of a plant. Progeny will inherit, and stably segregate, genes and transgenes from its parent plant(s).

Units, prefixes, and symbols may be denoted in their SI accepted form. Unless otherwise indicated, nucleic acids are written left to right in 5' to 3' orientation; amino acid sequences are written left to right in amino to carboxyl orientation, respectively. Numeric ranges recited within the specification are inclusive of the numbers defining the range and include each integer within the defined range. Amino acids may be referred to herein by either commonly known three letter symbols or by the one-letter symbols recommended by the IUPAC-IUB Biochemical Nomenclature Commission. Nucleotides, likewise, may be referred to by their commonly accepted single-letter codes. Unless otherwise provided for, software, electrical, and electronics terms as used herein are as defined in The New IEEE Standard Dictionary of Electrical and Electronics Terms (5$^{th}$ edition, 1993). The terms defined below are more fully defined by reference to the specification as a whole.

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., *EMBO J.* 4:2411-2418 (1985); De Almeida et al., *Mol. Gen. Genetics* 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

This construct may comprise any combination of deoxyribonucleotides, ribonucleotides, and/or modified nucleotides. The construct may be transcribed to form an RNA, wherein the RNA may be capable of forming a double-stranded RNA and/or hairpin structure. This construct may be expressed in the cell, or isolated or synthetically produced. The construct may further comprise a promoter, or other sequences which facilitate manipulation or expression of the construct.

As used here "suppression" or "silencing" or "inhibition" are used interchangeably to denote the down-regulation of the expression of a product of a target sequence relative to its normal expression level in a wild type organism. Suppression includes expression that is decreased by about 10%, 15%, 20%, 25%, 30%, 35%, 40%, 45%, 50%, 55%, 60%, 65%, 70%, 75%, 80%, 85%, 90%, 95%, or 100% relative to the wild type expression level.

As used herein, "encodes" or "encoding" refers to a DNA sequence which can be processed to generate an RNA and/or polypeptide.

As used herein, "expression" or "expressing" refers to production of a functional product, such as, the generation of an RNA transcript from an introduced construct, an endogenous DNA sequence, or a stably incorporated heterologous DNA sequence. The term may also refer to a polypeptide produced from an mRNA generated from any of the above DNA precursors. Thus, expression of a nucleic acid fragment may refer to transcription of the nucleic acid fragment (e.g., transcription resulting in mRNA or other functional RNA) and/or translation of RNA into a precursor or mature protein (polypeptide).

As used herein, "heterologous" with respect to a sequence means a sequence that originates from a foreign species, or, if from the same species, is substantially modified from its native form in composition and/or genomic locus by deliberate human intervention. For example, with respect to a nucleic acid, it can be a nucleic acid that originates from a foreign species, or is synthetically designed, or, if from the same species, is substantially modified from its native form in composition and/or genomic locus by deliberate human intervention. A heterologous protein may originate from a foreign species or, if from the same species, is substantially modified from its original form by deliberate human intervention.

The term "host cell" refers to a cell which contains or into which is introduced a nucleic acid construct and supports the replication and/or expression of the construct. Host cells may be prokaryotic cells such as *E. coli*, or eukaryotic cells such as fungi, yeast, insect, amphibian, nematode, or mammalian cells. Alternatively, the host cells are monocotyledonous or dicotyledonous plant cells. An example of a monocotyledonous host cell is a maize host cell.

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant DNA construct/expression construct) into ac ell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

The term "genome" as it applies to a plant cells encompasses not only chromosomal DNA found within the nucleus, but organelle DNA found within subcellular components (e.g., mitochondrial, plastid) of the cell.

The term "isolated" refers to material, such as a nucleic acid or a protein, which is: (1) substantially or essentially free from components which normally accompany or interact with the material as found in its naturally occurring environment or (2) if the material is in its natural environment, the material has been altered by deliberate human intervention to a composition and/or placed at a locus in the cell other than the locus native to the material.

As used herein, microRNA or "miRNA" refers to an oligoribonucleic acid, which regulates expression of a polynucleotide comprising the target sequence. A "mature miRNA" refers to the miRNA generated from the processing of a miRNA precursor. A "miRNA template" is an oligonucleotide region, or regions, in a nucleic acid construct which encodes the miRNA. The "backside" region of a miRNA is a portion of a polynucleotide construct which is substantially complementary to the miRNA template and is predicted to base pair with the miRNA template. The miRNA template and backside may form a double-stranded polynucleotide, including a hairpin structure.

As used herein, "domain" or "functional domain" refer to nucleic acid sequence(s) that are capable of eliciting a biological response in plants. The present invention concerns miRNAs composed of at least 21 nucleotide sequences acting either individually, or in concert with other miRNA sequences, therefore a domain could refer to either individual miRNAs or groups of miRNAs. Also, miRNA sequences associated with their backbone sequences could be considered domains useful for processing the miRNA into its active form. As used herein, "subdomains" or "functional subdomains" refer to subsequences of domains that are capable of eliciting a biological response in plants. A miRNA could be considered a subdomain of a backbone sequence. "Contiguous" sequences or domains refer to sequences that are sequentially linked without added nucleotides intervening between the domains. An example of a contiguous domain string is found in SEQ ID NO:7957 which represents SEQ ID NOs: 1-2652 as a continuous string that can be thought of as 2652 miRNA sequences linked together in a sequential concatenation.

As used herein, the phrases "target sequence" and "sequence of interest" are used interchangeably. Target sequence is used to mean the nucleic acid sequence that is selected for alteration (e.g., suppression) of expression, and is not limited to polynucleotides encoding polypeptides. The target sequence comprises a sequence that is substantially or fully complementary to the miRNA. The target sequence includes, but is not limited to, RNA, DNA, or a polynucleotide comprising the target sequence. As discussed in Bartel and Bartel (2003) Plant Phys. 132:709-719, most microRNA sequences are 20-22 nucleotides with anywhere from 0-3 mismatches when compared to their target sequences.

It is understood that microRNA sequences, such as the 21 nucleotide sequences of the present invention, may still be functional as shorter (20 nucleotide) or longer (22 nucleotide) sequences. In addition, some nucleotide substitutions, particularly at the last two nucleotides of the 3' end of the microRNA sequence, may be useful in retaining at least some microRNA function.

As used herein, "nucleic acid" means a polynucleotide and includes single or double-stranded polymer of deoxyribonucleotide or ribonucleotide bases. Nucleic acids may also include fragments and modified nucleotides. Thus, the terms "polynucleotide", "nucleic acid sequence", "nucleotide sequence" or "nucleic acid fragment" are used interchangeably and is a polymer of RNA or DNA that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deosycytidylate, "G" for guanylate or deoxyguanylate, "U" for uridlate, "T" for deosythymidylate, "R" for purines (A or G), "Y" for pyrimidiens (C or T), "K" for G or T, "H" for A or C or T, "I" for inosine, and "N" for any nucleotide.

By "nucleic acid library" is meant a collection of isolated DNA or RNA molecules which comprise and substantially represent the entire transcribed fraction of a genome of a specified organism or of a tissue from that organism. Construction of exemplary nucleic acid libraries, such as genomic and cDNA libraries, is taught in standard molecular biology references such as Berger and Kimmel, *Guide to Molecular Cloning Techniques, Methods in Enzymology*, Vol. 152, Academic Press, Inc., San Diego, Calif. (Berger); Sambrook et al., *Molecular Cloning—A Laboratory Manual*, 2nd ed., Vol. 1-3 (1989); and *Current Protocols in Molecular Biology*, F. M. Ausubel et al., Eds., Current Protocols, a joint venture between Greene Publishing Associates, Inc. and John Wiley & Sons, Inc. (1994).

As used herein "operably linked" includes reference to a functional linkage of at least two sequences. Operably linked includes linkage between a promoter and a second sequence, wherein the promoter sequence initiates and mediates transcription of the DNA sequence corresponding to the second sequence.

As used herein, "plant" includes plants and plant parts including but not limited to plant cells, plant tissue such as leaves, stems, roots, flowers, and seeds.

As used herein, "polypeptide" means proteins, protein fragments, modified proteins, amino acid sequences and synthetic amino acid sequences. The polypeptide can be glycosylated or not.

As used herein, "promoter" refers to a nucleic acid fragment, e.g., a region of DNA, that is involved in recognition and binding of an RNA polymerase and other proteins to initiate transcription. In other words, this nucleic acid fragment is capable of controlling transcription of another nucleic acid fragment.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth and Wahl, Anal. Biochem., 138:267-284 (1984): $T_m=81.5°$ C.$+16.6(\log M)+0.41(\% GC)-0.61(\% form)-500/L$; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≥90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and *Current Protocols in Molecular Biology*, Chapter 2, Ausubel et al., Eds., Greene Publishing and Wiley-Interscience, New York (1995). Hybridization and/or wash conditions can be applied for at least 10, 30, 60, 90, 120, or 240 minutes.

The terms "reliable detection" and "reliably detected" are defined herein to mean the reproducible detection of measurable, sequence-specific signal intensity above background noise.

As used herein, "transgenic" refers to a plant or a cell which comprises within its genome a heterologous polynucleotide. Preferably, the heterologous polynucleotide is stably integrated within the genome such that the polynucleotide is passed on, or heritable, to successive generations. The heterologous polynucleotide may be integrated into the genome alone or as part of an expression construct. Transgenic is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

As used herein, "vector" refers to a small nucleic acid molecule (plasmid, virus, bacteriophage, artificial or cut DNA molecule) that can be used to deliver a polynucleotide of the invention into a host cell. Vectors are capable of being replicated and contain cloning sites for introduction of a foreign polynucleotide, Thus, expression vectors permit transcription of a nucleic acid inserted therein.

Polynucleotide sequences may have substantial identity, substantial homology, or substantial complementarity to the selected region of the target gene. As used herein "substantial identity" and "substantial homology" indicate sequences that have sequence identity or homology to each other. Generally, sequences that are substantially identical or substantially homologous will have about 75%, 80%, 85%, 90%, 95%, or 100% sequence identity wherein the percent sequence identity is based on the entire sequence and is determined by GAP alignment using default parameters (GCG, GAP version 10, Accelrys, San Diego, Calif.). GAP uses the algorithm of Needleman and Wunsch (*J. Mol. Biol.* 48:443-453, 1970) to find the alignment of two complete sequences that maximizes the number of matches and minimizes the number of sequence gaps. Sequences which have 100% identity are identical. "Substantial complementarity" refers to sequences that are complementary to each other, and are able to base pair with each other. In describing complementary sequences, if all the nucleotides in the first sequence will base pair to the second sequence, these sequences are fully or completely complementary.

The present invention relates, inter alia, to an isolated polynucleotide comprising: a microRNA selected from the group consisting of SEQ ID NOs:1-2652 and SEQ ID NOs:7959-8114.

In a second embodiment, the invention relates to a full-length complement of the microRNA of selected from the group consisting of SEQ ID NOs:1-2652 and SEQ ID NOs: 7959-8114, or a nucleotide sequence capable of hybridizing to these aforemention microRNAs. wherein the hybridizable nucleotide sequence comprises at least 21 nucleotides.

In a third embodiment, the invention relates to an isolated polynucleotide useful for altering plant gene expression comprising SEQ ID NO:7957 or SEQ ID NO:8427 wherein said isolated polynucleotide comprises at least one functional domain having at least 21(x) contiguous nucleotides and x is an integer from 1 to 2652, further wherein said nucleotides start at nucleotide 1 or any nucleotide 21(x)+1.

In a fourth embodiment, the invention relates to a functional subdomain of such isolated polynucleotides, wherein said functional subdomain comprises at least one microRNA.

In a fifth embodiment, the invention relates to an isolated polynucleotide comprising: a microRNA containing sequence selected from the group consisting of SEQ ID NOs: 5305-7956 and SEQ ID NOs:8271-8426.

Computational identification of miRNAs was accomplished from size selected small RNA libraries from leaf, drought-stressed leaf, seed, and various other tissues.

In some embodiments, the miRNA template, (i.e. the polynucleotide encoding the miRNA), and thereby the miRNA, may comprise some mismatches relative to the target sequence. In some embodiments the miRNA template has ≥1 nucleotide mismatch as compared to the target sequence, for example, the miRNA template can have 1, 2, 3, 4, 5, or more mismatches as compared to the target sequence. This degree of mismatch may also be described by determining the percent identity of the miRNA template to the complement of the target sequence. For example, the miRNA template may have a percent identity including about at least 70%, 75%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% as compared to the complement of the target sequence.

In some embodiments, the miRNA template, (i.e. the polynucleotide encoding the miRNA) and thereby the miRNA, may comprise some mismatches relative to the miRNA backside. In some embodiments the miRNA template has ≥1 nucleotide mismatch as compared to the miRNA backside, for example, the miRNA template can have 1, 2, 3, 4, 5, or more mismatches as compared to the miRNA backside. This degree of mismatch may also be described by determining the percent identity of the miRNA template to the complement of the miRNA backside. For example, the miRNA template may have a percent identity including about at least 70%, 75%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% as compared to the complement of the miRNA backside.

In some embodiments, the target sequence is selected from a plant pathogen. Plants or cells comprising a miRNA directed to the target sequence of the pathogen are expected to have decreased sensitivity and/or increased resistance to the pathogen. In some embodiments, the miRNA is encoded by a nucleic acid construct further comprising an operably linked promoter. In some embodiments, the promoter is a pathogen-inducible promoter.

In another embodiment, there is provided a nucleic acid construct for suppressing a target sequence. The nucleic acid construct encodes a miRNA substantially complementary to the target. In some embodiments, the nucleic acid construct further comprises a promoter operably linked to the polynucleotide encoding the miRNA. In some embodiments, the nucleic acid construct lacking a promoter is designed and introduced in such a way that it becomes operably linked to a promoter upon integration in the host genome. In some embodiments, the nucleic acid construct is integrated using recombination, including site-specific recombination. See, for example, WO 99/25821, herein incorporated by reference. In some embodiments, the nucleic acid construct is an RNA. In some embodiments, the nucleic acid construct comprises at least one recombination site, including site-specific recombination sites. In some embodiments the nucleic acid construct comprises at least one recombination site in order to facilitate integration, modification, or cloning of the construct. In some embodiments the nucleic acid construct comprises two site-specific recombination sites flanking the miRNA precursor. In some embodiments the site-specific recombination sites include FRT sites, lox sites, or att sites, including attB, attL, attP or attR sites. See, for example, WO 99/25821, and U.S. Pat. Nos. 5,888,732, 6,143,557, 6,171, 861, 6,270,969, and 6,277,608, herein incorporated by reference.

In a sixth embodiment, the invention relates to a DNA expression construct comprising any of the isolated polynucleotides discussed herein operably linked to at least one regulatory sequence.

In a seventh embodiment, the invention relates to a plant comprising in its genome the DNA expression constructs discussed herein. Such plants can be selected from the group consisting of corn, rice, sorghum, sunflower, millet, soybean, canola, wheat, barley, oat, beans, and nuts.

In a eighth embodiment, the invention relates to transgenic seeds obtained from a plant comprising in its genome the DNA expression constructs discussed herein. Also within the scope of the invention are transformed plant tissue or a plant cell comprising in its genome the DNA expression constructs discussed herein.

In an ninth embodiment, the invention relates to by-products and progeny plants obtained from such transgenic seeds.

In another embodiment, the nucleic acid construct comprises an isolated polynucleotide comprising a polynucleotide which encodes a modified plant miRNA precursor, the modified precursor comprising a first and a second oligonucleotide, wherein at least one of the first or the second oligonucleotides is heterologous to the precursor, wherein the first oligonucleotide is substantially complementary to the second oligonucleotide, and the second oligonucleotide comprises a miRNA substantially complementary to the target sequence, wherein the precursor is capable of forming a hairpin.

In some embodiments there are provided cells, plants, and seeds comprising the introduced polynucleotides, and/or produced by the methods of the invention. The cells include prokaryotic and eukaryotic cells, including but not limited to bacteria, yeast, fungi, viral, invertebrate, vertebrate, and plant cells. Plants, plant cells, and seeds of the invention include gynosperms, monocots and dicots, including but not limited to, for example, rice, wheat, oats, barley, millet, sorghum, soy, sunflower, safflower, canola, alfalfa, cotton, *Arabidopsis*, and tobacco.

As used herein, "by-products" refer to any product, fraction, or material produced from the processing of the seed. Corn kernels (seeds) are subjected to both wet and dry milling. The goal of both processes is to separate the germ, the endosperm, and the pericarp (hull). Wet milling separates the chemical constituents of corn into starch, protein, oil, and fiber fractions.

The present invention concerns methods and compositions useful in suppression of a target sequence and/or validation of function. The invention also relates to a method for using microRNA (miRNA) mediated RNA interference (RNAi) to silence or suppress a target sequence to evaluate function, or to validate a target sequence for phenotypic effect and/or trait development. Specifically, the invention relates to constructs comprising small nucleic acid molecules, miRNAs, capable of inducing silencing, and methods of using these miRNAs to selectively silence target sequences.

RNA interference refers to the process of sequence-specific post-transcriptional gene silencing in animals mediated by short interfering RNAs (siRNAs) (Fire et al., *Nature* 391: 806 1998). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., *Trends Genet.* 15:358 1999). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as "dicer". Dicer is involved in the processing of the dsRNA into short pieces of dsRNA known as short interfering RNAs (siRNAs) (Berstein et al., *Nature* 409:363 2001) and/or pre miRNAs into miR-NAs. Short interfering RNAs derived from dicer activity are typically about 21 to about 23 nucleotides in length and comprise about 19 base pair duplexes (Elbashir et al., *Genes Dev.* 15:188 2001). Dicer has also been implicated in the excision of 21- and 22-nucleotide small temporal RNAs (stR-NAs) from precursor RNA of conserved structure that are implicated in translational control (Hutvagner et al., 2001, *Science* 293:834). The RNAi response also features an endonuclease complex, commonly referred to as an RNA-induced silencing complex (RISC), which mediates cleavage of single-stranded RNA having sequence complementarity to the antisense strand of the sRNA duplex. Cleavage of the target RNA takes place in the middle of the region complementary to the antisense strand of the sRNA duplex (Elbashir et al., *Genes Dev.* 15:188 2001). In addition, RNA interference can also involve small RNA (e.g., microRNA, or miRNA) mediated gene silencing, presumably through cellular mechanisms that regulate chromatin structure and thereby prevent transcription of target gene sequences (see, e.g., Allshire, *Science* 297:1818-1819 2002; Volpe et al., *Science* 297:1833-1837 2002; Jenuwein, *Science* 297:2215-2218 2002; and Hall et al., *Science* 297:2232-2237 2002). As such, miRNA molecules of the invention can be used to mediate gene silencing via interaction with RNA transcripts or alternately by interaction with particular gene sequences, wherein such interaction results in gene silencing either at the transcriptional or post-transcriptional level.

RNAi has been studied in a variety of systems. Fire et al. (*Nature* 391:806 1998) were the first to observe RNAi in *C. elegans*. Wianny and Goetz (*Nature Cell Biol.* 2:70 1999) describe RNAi mediated by dsRNA in mouse embryos. Hammond et al. (*Nature* 404:293 2000) describe RNAi in *Drosophila* cells transfected with dsRNA. Elbashir et al., (*Nature* 411:494 2001) describe RNAi induced by introduction of duplexes of synthetic 21-nucleotide RNAs in cultured mammalian cells including human embryonic kidney and HeLa cells.

Small RNAs play an important role in controlling gene expression. Regulation of many developmental processes, including flowering, is controlled by small RNAs. It is now possible to engineer changes in gene expression of plant genes by using transgenic constructs which produce small RNAs in the plant.

Small RNAs appear to function by base-pairing to complementary RNA or DNA target sequences. When bound to RNA, small RNAs trigger either RNA cleavage or translational inhibition of the target sequence. When bound to DNA target sequences, it is thought that small RNAs can mediate DNA methylation of the target sequence. The consequence of these events, regardless of the specific mechanism, is that gene expression is inhibited.

MicroRNAs (miRNAs) are noncoding RNAs of about 19 to about 24 nucleotides (nt) in length that have been identified in both animals and plants (Lagos-Quintana et al., *Science* 294:853-858 2001, Lagos-Quintana et al., *Curr. Biol.* 12:735-739 2002; Lau et al., *Science* 294:858-862 2001; Lee and Ambros, *Science* 294:862-864 2001; Llave et al., *Plant Cell* 14:1605-1619 2002; Mourelatos et al., *Genes. Dev.* 16:720-728 2002; Park et al., *Curr. Biol.* 12:1484-1495 2002; Reinhart et al., *Genes. Dev.* 16:1616-1626 2002). They are processed from longer precursor transcripts that range in size from approximately 70 to 200 nt, and these precursor transcripts have the ability to form stable hairpin structures. In animals, the enzyme involved in processing miRNA precursors is called Dicer, an RNAse III-like protein (Grishok et al., *Cell* 106:23-34 2001; Hutvagner et al., *Science* 293:834-838 2001; Ketting et al., *Genes. Dev.* 15:2654-2659 2001). Plants also have a Dicer-like enzyme, DCL1 (previously named CARPEL FACTORY/SHORT INTEGUMENTS1/SUS-PENSOR1), and recent evidence indicates that it, like Dicer, is involved in processing the hairpin precursors to generate mature miRNAs (Park et al., *Curr. Biol.* 12:1484-1495 2002; Reinhart et al., *Genes. Dev.* 16:1616-1626 2002). Furthermore, it is becoming clear from recent work that at least some miRNA hairpin precursors originate as longer polyadenylated transcripts, and several different miRNAs and associated hairpins can be present in a single transcript (Lagos-Quintana et al., *Science* 294:853-858 2001; Lee et al., *EMBO J* 21:4663-4670 2002). Recent work has also examined the selection of the miRNA strand from the dsRNA product arising from processing of the hairpin by DICER (Schwartz et al., 2003, *Cell* 115:199-208). It appears that the stability (i.e. G:C vs. A:U content, and/or mismatches) of the two ends of the processed dsRNA affects the strand selection, with the low stability end being easier to unwind by a helicase activity. The 5' end strand at the low stability end is incorporated into the RISC complex, while the other strand is degraded.

In animals, there is direct evidence indicating a role for specific miRNAs in development. The lin-4 and let-7 miR-NAs in *C. elegans* have been found to control temporal development, based on the phenotypes generated when the genes producing the lin-4 and let-7 miRNAs are mutated (Lee et al., *Cell* 75:843-854 1993; Reinhart et al., *Nature* 403-901-906 2000). In addition, both miRNAs display a temporal expression pattern consistent with their roles in developmental timing. Other animal miRNAs display developmentally regulated patterns of expression, both temporal and tissue-specific (Lagos-Quintana et al., *Science* 294:853-853 2001, Lagos-Quintana et al., *Curr. Biol.* 12:735-739 2002; Lau et al., *Science* 294:858-862 2001; Lee and Ambros, *Science* 294: 862-864 2001), leading to the hypothesis that miRNAs may, in many cases, be involved in the regulation of important developmental processes. Likewise, in plants, the differential expression patterns of many miRNAs suggests a role in development (Llave et al., *Plant Cell* 14:1605-1619 2002; Park et al., *Curr. Biol.* 12:1484-1495 2002; Reinhart et al., *Genes. Dev.* 16:1616-1626 2002). However, a developmental role for miRNAs has not been directly proven in plants, because to date there has been no report of a developmental phenotype associated with a specific plant miRNA.

MicroRNAs appear to regulate target genes by binding to complementary sequences located in the transcripts produced by these genes. In the case of lin-4 and let-7, the target sites are located in the 3' UTRs of the target mRNAs (Lee et al., *Cell* 75:843-854 1993; Wightman et al., *Cell* 75:855-862 1993; Reinhart et al., *Nature* 403:901-906 2000; Slack et al., *Mol. Cell* 5:659-669 2000), and there are several mismatches between the lin-4 and let-7 miRNAs and their target sites. Binding of the lin-4 or let-7 miRNA appears to cause downregulation of steady-state levels of the protein encoded by the target mRNA without affecting the transcript itself (Olsen and Ambros, *Dev. Biol.* 216:671-680 1999). On the other hand, recent evidence suggests that miRNAs can, in some cases, cause specific RNA cleavage of the target transcript within the target site, and this cleavage step appears to require 100% complementarity between the miRNA and the target transcript (Hutvagner and Zamore, *Science* 297:2056-2060 2002; Llave et al., *Plant Cell* 14:1605-1619 2002). It seems likely that miRNAs can enter at least two pathways of target gene regulation: Protein downregulation when target complementarity is <100%, and RNA cleavage when target complementarity is 100%. MicroRNAs entering the RNA cleavage pathway are analogous to the 21-25 nt short interfering RNAs (siRNAs) generated during RNA interference (RNAi) in animals and posttranscriptional gene silencing (PTGS) in plants (Hamilton and Baulcombe 1999; Hammond et al., 2000; Zamore et al., 2000; Elbashir et al., 2001), and likely are incorporated into an RNA-induced silencing complex (RISC) that is similar or identical to that seen for RNAi.

Identifying the targets of miRNAs with bioinformatics has not been successful in animals, and this is probably due to the fact that animal miRNAs have a low degree of complementarity with their targets. On the other hand, bioinformatic approaches have been successfully used to predict targets for plant miRNAs (Llave et al., *Plant Cell* 14:1605-1619 2002; Park et al., *Curr. Biol.* 12:1484-1495 2002; Rhoades et al., *Cell* 110:513-520 2002), and thus it appears that plant miRNAs have higher overall complementarity with their putative targets than do animal miRNAs. Most of these predicted target transcripts of plant miRNAs encode members of transcription factor families implicated in plant developmental patterning or cell differentiation. Nonetheless, biological function has not been directly demonstrated for any plant miRNA. Although Llave et al. (*Science* 297:2053-2056 2002) have shown that a transcript for a SCARECROW-like transcription factor is a target of the *Arabidopsis* miRNA mir171, these studies were performed in a heterologous species and no plant phenotype associated with mir171 was reported.

The methods provided can be practiced in any organism in which a method of transformation is available, and for which there is at least some sequence information for the target sequence, or for a region flanking the target sequence of interest. It is also understood that two or more sequences could be targeted by sequential transformation, co-transformation with more than one targeting vector, or the construction of a DNA construct comprising more than one miRNA sequence. The methods of the invention may also be implemented by a combinatorial nucleic acid library construction in order to generate a library of miRNAs directed to random target sequences. The library of miRNAs could be used for high-throughput screening for gene function validation.

General categories of sequences of interest include, for example, those genes involved in regulation or information, such as zinc fingers, transcription factors, homeotic genes, or cell cycle and cell death modulators, those involved in communication, such as kinases, and those involved in housekeeping, such as heat shock proteins.

Target sequences further include coding regions and noncoding regions such as promoters, enhancers, terminators, introns and the like, which may be modified in order to alter the expression of a gene of interest. For example, an intron sequence can be added to the 5' region to increase the amount of mature message that accumulates (see for example Buchman and Berg, *Mol. Cell Biol.* 8:4395-4405 (1988); and Callis et al., *Genes Dev.* 1:1183-1200 (1987)).

The target sequence may be an endogenous sequence, or may be an introduced heterologous sequence, or transgene. For example, the methods may be used to alter the regulation or expression of a transgene, or to remove a transgene or other introduced sequence such as an introduced site-specific recombination site. The target sequence may also be a sequence from a pathogen, for example, the target sequence may be from a plant pathogen such as a virus, a mold or fungus, an insect, or a nematode. A miRNA could be expressed in a plant which, upon infection or infestation, would target the pathogen and confer some degree of resistance to the plant.

In plants, other categories of target sequences include genes affecting agronomic traits, insect resistance, disease resistance, herbicide resistance, sterility, grain characteristics, and commercial products. Genes of interest also included those involved in oil, starch, carbohydrate, or nutrient metabolism as well as those affecting, for example, kernel size, sucrose loading, and the like. The quality of grain is reflected in traits such as levels and types of oils, saturated and unsaturated, quality and quantity of essential amino acids, and levels of cellulose. For example, genes of the phytic acid biosynthetic pathway could be suppressed to generate a high available phosphorous phenotype. See, for example, phytic acid biosynthetic enzymes including inositol polyphosphate kinase-2 polynucleotides, disclosed in WO 02/059324, inositol 1,3,4-trisphosphate 5/6-kinase polynucleotides, disclosed in WO 03/027243, and myo-inositol 1-phosphate synthase and other phytate biosynthetic polynucleotides, disclosed in WO 99/05298, all of which are herein incorporated by reference. Genes in the lignification pathway could be suppressed to enhance digestibility or energy availability. Genes affecting cell cycle or cell death could be suppressed to affect growth or stress response. Genes affecting DNA repair and/or recombination could be suppressed to increase genetic variability. Genes affecting flowering time could be suppressed, as well as genes affecting fertility. Any target sequence could be suppressed in order to evaluate or confirm its role in a particular trait or phenotype, or to dissect a molecular, regulatory, biochemical, or proteomic pathway or network.

A number of promoters can be used, these promoters can be selected based on the desired outcome. It is recognized that different applications will be enhanced by the use of different promoters in plant expression cassettes to modulate the timing, location and/or level of expression of the miRNA. Such plant expression cassettes may also contain, if desired, a promoter regulatory region (e.g., one conferring inducible, constitutive, environmentally- or developmentally-regulated, or cell- or tissue-specific/selective expression), a transcription initiation start site, a ribosome binding site, an RNA processing signal, a transcription termination site, and/or a polyadenylation signal.

Constitutive, tissue-preferred or inducible promoters can be employed. Examples of constitutive promoters include the cauliflower mosaic virus (CaMV) 35S transcription initiation region, the 1'- or 2'-promoter derived from T-DNA of *Agrobacterium tumefaciens*, the ubiquitin 1 promoter, the Smas promoter, the cinnamyl alcohol dehydrogenase promoter (U.S. Pat. No. 5,683,439), the Nos promoter, the pEmu promoter, the rubisco promoter, the GRP1-8 promoter and other transcription initiation regions from various plant genes known to those of skill. If low level expression is desired, weak promoter(s) may be used. Weak constitutive promoters include, for example, the core promoter of the Rsyn7 promoter (WO 99/43838 and U.S. Pat. No. 6,072,050), the core 35S CaMV promoter, and the like. Other constitutive promoters include, for example, U.S. Pat. Nos. 5,608,149; 5,608, 144; 5,604,121; 5,569,597; 5,466,785; 5,399,680; 5,268,463; and 5,608,142. See also, U.S. Pat. No. 6,177,611, herein incorporated by reference.

Examples of inducible promoters are the Adh1 promoter which is inducible by hypoxia or cold stress, the Hsp70 promoter which is inducible by heat stress, the PPDK promoter and the pepcarboxylase promoter which are both inducible by light. Also useful are promoters which are chemically inducible, such as the In2-2 promoter which is safener induced (U.S. Pat. No. 5,364,780), the ERE promoter which is estrogen induced, and the Axig1 promoter which is auxin induced and tapetum specific but also active in callus (PCT US01/22169).

Examples of promoters under developmental control include promoters that initiate transcription preferentially in certain tissues, such as leaves, roots, fruit, seeds, or flowers. An exemplary promoter is the anther specific promoter 5126 (U.S. Pat. Nos. 5,689,049 and 5,689,051). Examples of seed-preferred promoters include, but are not limited to, 27 kD gamma zein promoter and waxy promoter, Boronat, A. et al. (1986) *Plant Sci.* 47:95-102; Reina, M. et al. *Nucl. Acids Res.* 18(21):6426; and Kloesgen, R. B. et al. (1986) *Mol. Gen. Genet.* 203:237-244. Promoters that express in the embryo, pericarp, and endosperm are disclosed in U.S. Pat. No. 6,225, 529 and PCT publication WO 00/12733. The disclosures each of these are incorporated herein by reference in their entirety.

In some embodiments it will be beneficial to express the gene from an inducible promoter, particularly from a pathogen-inducible promoter. Such promoters include those from pathogenesis-related proteins (PR proteins), which are induced following infection by a pathogen; e.g., PR proteins, SAR proteins, beta-1,3-glucanase, chitinase, etc. See, for example, Redolfi et al. (1983) *Neth. J. Plant Pathol.* 89:245-254; Uknes et al. (1992) *Plant Cell* 4:645-656; and Van Loon (1985) *Plant Mol. Virol.* 4:111-116. See also WO 99/43819, herein incorporated by reference.

Of interest are promoters that are expressed locally at or near the site of pathogen infection. See, for example, Marineau et al. (1987) *Plant Mol. Biol.* 9:335-342; Matton et al. (1989) *Molecular Plant-Microbe Interactions* 2:325-331; Somsisch et al. (1986) *Proc. Natl. Acad. Sci. USA* 83:2427-2430; Somsisch et al. (1988) *Mol. Gen. Genet.* 2:93-98; and Yang (1996) *Proc. Natl. Acad. Sci. USA* 93:14972-14977. See also, Chen et al. (1996) *Plant J.* 10:955-966; Zhang et al. (1994) *Proc. Natl. Acad. Sci. USA* 91:2507-2511; Warner et al. (1993) *Plant J.* 3:191-201; Siebertz et al. (1989) *Plant Cell* 1:961-968; U.S. Pat. No. 5,750,386 (nematode-inducible); and the references cited therein. Of particular interest is the inducible promoter for the maize PRms gene, whose expression is induced by the pathogen *Fusarium moniliforme* (see, for example, Cordero et al. (1992) *Physiol. Mol. Plant. Path.* 41:189-200).

Additionally, as pathogens find entry into plants through wounds or insect damage, a wound-inducible promoter may be used in the constructions of the polynucleotides. Such wound-inducible promoters include potato proteinase inhibitor (pin II) gene (Ryan (1990) *Ann. Rev. Phytopath.* 28:425-449; Duan et al. (1996) *Nature Biotech.* 14:494-498); wun1 and wun2, U.S. Pat. No. 5,428,148; win1 and win2 (Stanford et al. (1989) *Mol. Gen. Genet.* 215:200-208); systemin (McGurl et al. (1992) *Science* 225:1570-1573); WIP1 (Rohmeier et al. (1993) *Plant Mol. Biol.* 22:783-792; Eckelkamp et al. (1993) *FEBS Lett.* 323:73-76); MPI gene (Corderok et al. (1994) *Plant J.* 6(2):141-150); and the like, herein incorporated by reference.

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991) *Mol. Gen. Genet.* 227:229-237, and U.S. Pat. Nos. 5,814,618 and 5,789,156), herein incorporated by reference.

Tissue-preferred promoters can be utilized to target enhanced expression of a sequence of interest within a particular plant tissue. Tissue-preferred promoters include Yamamoto et al. (1997) *Plant J.* 12(2):255-265; Kawamata et al. (1997) *Plant Cell Physiol.* 38(7):792-803; Hansen et al. (1997) *Mol. Gen. Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590. In addition, the promoters of cab and rubisco can also be used. See, for example, Simpson et al. (1958) *EMBO J* 4:2723-2729 and Timko et al. (1988) *Nature* 318:57-58.

Root-preferred promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agrobacterium tumefaciens*); and Miao et al. (1991) *Plant Cell* 3(1):11-22 (full-length cDNA clone encoding cytosolic glutamine synthetase (GS), which is expressed in roots and root nodules of soybean). See also Bogusz et al. (1990) *Plant Cell* 2(7): 633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi (1991) describe their analysis of the promoters of the highly expressed roIC and roID root-inducing genes of *Agrobacterium rhizogenes* (see *Plant Science* (Limerick) 79(1):69-76). They concluded that enhancer and tissue-preferred DNA determinants are dissociated in those promoters. Teeri et al. (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see *EMBO J.* 8(2):343-350). The TR1' gene, fused to nptII (neomycin phosphotransferase II) showed similar characteristics. Additional root-preferred promoters include the VfENOD-GRP3 gene promoter (Kuster et al. (1995) *Plant Mol. Biol.* 29(4):759-772); and roIB promoter (Capana et al. (1994) *Plant Mol. Biol.* 25(4):681-691. See also U.S. Pat. Nos. 5,837,876; 5,750,386; 5,633,363; 5,459,252; 5,401,836; 5,110,732; and 5,023,179. The phaseolin gene (Murai et al. (1983) *Science* 23:476-482 and Sengopta-Gopalen et al. (1988) *PNAS* 82:3320-3324.

Transformation protocols as well as protocols for introducing nucleotide sequences into plants may vary depending on the type of plant or plant cell, i.e., monocot or dicot, targeted for transformation. Suitable methods of introducing the DNA construct include microinjection (Crossway et al. (1986) *Biotechniques* 4:320-334; and U.S. Pat. No. 6,300,543), sexual crossing, electroporation (Riggs et al. (1986) *Proc. Natl. Acad. Sci. USA* 83:5602-5606), *Agrobacterium*-mediated transformation (Townsend et al., U.S. Pat. No. 5,563,055; and U.S. Pat. No. 5,981,840), direct gene transfer (Paszkowski et al. (1984) *EMBO J.* 3:2717-2722), and ballistic particle acceleration (see, for example, Sanford et al., U.S. Pat. No. 4,945,050; Tomes et al., U.S. Pat. No. 5,879,918; Tomes et al., U.S. Pat. No. 5,886,244; Bidney et al., U.S. Pat. No. 5,932,782; Tomes et al. (1995) "Direct DNA Transfer into Intact Plant Cells via Microprojectile Bombardment," in *Plant Cell, Tissue, and Organ Culture: Fundamental Methods*, ed. Gamborg and Phillips (Springer-Verlag, Berlin); and McCabe et al. (1988) *Biotechnology* 6:923-926). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); Tomes, U.S. Pat. No. 5,240,855; Buising et al., U.S. Pat. Nos. 5,322,783 and 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; Bowen et al., U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); and U.S. Pat. No. 5,736,369 (meristem transformation), all of which are herein incorporated by reference.

The nucleotide constructs may be introduced into plants by contacting plants with a virus or viral nucleic acids. Generally, such methods involve incorporating a nucleotide construct of the invention within a viral DNA or RNA molecule. Further, it is recognized that useful promoters encompass promoters utilized for transcription by viral RNA polymerases. Methods for introducing nucleotide constructs into plants and expressing a protein encoded therein, involving viral DNA or RNA molecules, are known in the art. See, for example, U.S. Pat. Nos. 5,889,191, 5,889,190, 5,866,785, 5,589,367 and 5,316,931; herein incorporated by reference.

In some embodiments, transient expression may be desired. In those cases, standard transient transformation techniques may be used. Such methods include, but are not limited to viral transformation methods, and microinjection of DNA or RNA, as well other methods well known in the art.

The cells from the plants that have stably incorporated the nucleotide sequence may be grown into plants in accordance with conventional ways. See, for example, McCormick et al. (1986) *Plant Cell Reports* 5:81-84. These plants may then be grown, and either pollinated with the same transformed strain or different strains, and the resulting hybrid having constitutive expression of the desired phenotypic characteristic imparted by the nucleotide sequence of interest and/or the genetic markers contained within the target site or transfer cassette. Two or more generations may be grown to ensure that expression of the desired phenotypic characteristic is stably maintained and inherited and then seeds harvested to ensure expression of the desired phenotypic characteristic has been achieved.

In a tenth embodiment, the invention relates to a method for altering expression of a stably introduced nucleotide sequence in a plant comprising:

a) making a DNA expression construct comprising a stably introduced nucleotide sequence and at least one sequence capable of hybridizing to the isolated polynucleotide of the invention;
  b) transforming a plant with the DNA expression construct of part (a); and c) selecting a transformed plant which comprises the DNA expression construct of part (a) in its genome and which has altered expression of the stably introduced nucleotide sequence when compared to a plant transformed with a modified version of the DNA expression construct of part (a) wherein the modified construct lacks the sequence capable of hybridizing to the isolated polynucleotide of the invention.

Initial identification and selection of cells and/or plants comprising the DNA constructs may be facilitated by the use of marker genes. Gene targeting can be performed without selection if there is a sensitive method for identifying recombinants, for example if the targeted gene modification can be easily detected by PCR analysis, or if it results in a certain phenotype. However, in most cases, identification of gene targeting events will be facilitated by the use of markers. Useful markers include positive and negative selectable markers as well as markers that facilitate screening, such as visual markers. Selectable markers include genes carrying resistance to an antibiotic such as spectinomycin (e.g. the aada gene, Svab et al. 1990 *Plant Mol. Biol.* 14:197), streptomycin (e.g., aada, or SPT, Svab et al. 1990 *Plant Mol. Biol.* 14:197; Jones et al. 1987 *Mol. Gen. Genet.* 210:86), kanamycin (e.g., nptII, Fraley et al. 1983 *PNAS* 80:4803), hygromycin (e.g., HPT, Vanden Elzen et al. 1985 *Plant Mol. Biol.* 5:299), gentamycin (Hayford et al. 1988 *Plant Physiol.* 86:1216), phleomycin, zeocin, or bleomycin (Hille et al. 1986 *Plant Mol. Biol.* 7:171), or resistance to a herbicide such as phosphinothricin (bar gene), or sulfonylurea (acetolactate synthase (ALS)) (Charest et al. (1990) *Plant Cell Rep.* 8:643), genes that fulfill a growth requirement on an incomplete media such as HIS3, LEU2, URA3, LYS2, and TRP1 genes in yeast, and other such genes known in the art. Negative selectable markers include cytosine deaminase (codA) (Stougaard 1993 *Plant J.* 3:755-761), tms2 (DePicker et al. 1988 *Plant Cell Rep.* 7:63-66), nitrate reductase (Nussame et al. 1991 *Plant J.* 1:267-274), SU1 (O'Keefe et al. 1994 *Plant Physiol.* 105:473-482), aux-2 from the Ti plasmid of *Agrobacterium*, and thymidine kinase. Screenable markers include fluorescent proteins such as green fluorescent protein (GFP) (Chalfie et al., 1994 *Science* 263:802; U.S. Pat. No. 6,146,826; U.S. Pat. No. 5,491,084; and WO 97/41228), reporter enzymes such as β-glucuronidase (GUS) (Jefferson R. A. 1987 *Plant Mol. Biol. Rep.* 5:387; U.S. Pat. No. 5,599,670; and U.S. Pat. No. 5,432,081), β-galactosidase (lacZ), alkaline phosphatase (AP), glutathione S-transferase (GST) and luciferase (U.S. Pat. No. 5,674,713; and Ow et al. 1986 *Science* 234(4778): 856-859), visual markers like anthocyanins such as CRC (Ludwig et al. (1990) *Science* 247(4841):449-450) R gene family (e.g. Lc, P, S), A, C, R-nj, body and/or eye color genes in *Drosophila*, coat color genes in mammalian systems, and others known in the art.

One or more markers may be used in order to select and screen for gene targeting events. One common strategy for gene disruption involves using a target modifying polynucleotide in which the target is disrupted by a promoterless selectable marker. Since the selectable marker lacks a promoter, random integration events are unlikely to lead to transcription of the gene. Gene targeting events will put the selectable marker under control of the promoter for the target gene. Gene targeting events are identified by selection for expression of the selectable marker. Another common strategy utilizes a positive-negative selection scheme. This scheme utilizes two selectable markers, one that confers resistance (R+) coupled with one that confers a sensitivity (S+), each with a promoter. When this polynucleotide is randomly inserted, the resulting phenotype is R+/S+. When a gene targeting event is generated, the two markers are uncoupled and the resulting phenotype is R+/S−. Examples of using positive-negative selection are found in Thykjr et al. (1997) *Plant Mol. Biol.* 35:523-530; and WO 01/66717, which are herein incorporated by reference.

EXAMPLES

The following are non-limiting examples intended to illustrate the invention. Although the present invention has been described in some detail by way of illustration and example for purposes of clarity of understanding, it will be obvious that certain changes and modifications may be practiced within the scope of the appended claims.

Example 1

Transformation of Plants

Described in this example are methods one may use for introduction of a polynucleotide or polypeptide into a plant cell.

A. Maize Particle-Mediated DNA Delivery

A DNA construct can be introduced into maize cells capable of growth on suitable maize culture medium. Such competent cells can be from maize suspension culture, callus culture on solid medium, freshly isolated immature embryos or meristem cells. Immature embryos of the Hi-II genotype can be used as the target cells. Ears are harvested at approximately 10 days post-pollination, and 1.2-1.5 mm immature embryos are isolated from the kernels, and placed scutellum-side down on maize culture medium.

The immature embryos are bombarded from 18-72 hours after being harvested from the ear. Between 6 and 18 hours prior to bombardment, the immature embryos are placed on medium with additional osmoticum (MS basal medium, Musashige and Skoog, 1962, *Physiol. Plant* 15:473-497, with 0.25 M sorbitol). The embryos on the high-osmotic medium are used as the bombardment target, and are left on this medium for an additional 18 hours after bombardment.

For particle bombardment, plasmid DNA (described above) is precipitated onto 1.8 mm tungsten particles using standard CaCl2-spermidine chemistry (see, for example, Klein et al., 1987, *Nature* 327:70-73). Each plate is bombarded once at 600 PSI, using a DuPont Helium Gun (Lowe et al., 1995, *Bio/Technol* 13:677-682). For typical media formulations used for maize immature embryo isolation, callus initiation, callus proliferation and regeneration of plants, see Armstrong, C., 1994, In "The Maize Handbook", M. Freeling and V. Walbot, eds. Springer Verlag, N.Y., pp 663-671.

Within 1-7 days after particle bombardment, the embryos are moved onto N6-based culture medium containing 3 mg/l of the selective agent bialaphos. Embryos, and later callus, are transferred to fresh selection plates every 2 weeks. The calli developing from the immature embryos are screened for the desired phenotype. After 6-8 weeks, transformed calli are recovered.

B. Soybean Transformation

Soybean embryogenic suspension cultures are maintained in 35 ml liquid media SB196 or SB172 in 250 ml Erlenmeyer flasks on a rotary shaker, 150 rpm, 26 C with cool white fluorescent lights on 16:8 hr day/night photoperiod at light intensity of 30-35 uE/m2s. Cultures are subcultured every two weeks by inoculating approximately 35 mg of tissue into 35 ml of fresh liquid media. Alternatively, cultures are initiated and maintained in 6-well Costar plates.

SB 172 media is prepared as follows: (per liter), 1 bottle Murashige and Skoog Medium (Duchefa #M 0240), 1 ml B5 vitamins 1000× stock, 1 ml 2,4-D stock (Gibco 11215-019), 60 g sucrose, 2 g MES, 0.667 g L-Asparagine anhydrous (GibcoBRL 11013-026), pH 5.7. SB 196 media is prepared as follows: (per liter) 10 ml MS FeEDTA, 10 ml MS Sulfate, 10 ml FN-Lite Halides, 10 ml FN-Lite P,B,Mo, 1 ml B5 vitamins 1000× stock, 1 ml 2,4-D, (Gibco 11215-019), 2.83 g KNO3, 0.463 g (NH4)2SO4, 2 g MES, 1 g Asparagine Anhydrous, Powder (Gibco 11013-026), 10 g Sucrose, pH 5.8. 2,4-D stock concentration 10 mg/ml is prepared as follows: 2,4-D is solubilized in 0.1 N NaOH, filter-sterilized, and stored at −20° C. B5 vitamins 1000× stock is prepared as follows: (per 100 ml)-store aliquots at −20° C., 10 g myo-inositol, 100 mg nicotinic acid, 100 mg pyridoxine HCl, 1 g thiamin.

Soybean embryogenic suspension cultures are transformed with various plasmids by the method of particle gun bombardment (Klein et al., 1987 *Nature* 327:70. To prepare tissue for bombardment, approximately two flasks of suspension culture tissue that has had approximately 1 to 2 weeks to recover since its most recent subculture is placed in a sterile 60×20 mm petri dish containing 1 sterile filter paper in the bottom to help absorb moisture. Tissue (i.e. suspension clusters approximately 3-5 mm in size) is spread evenly across each petri plate. Residual liquid is removed from the tissue with a pipette, or allowed to evaporate to remove excess moisture prior to bombardment. Per experiment, 4-6 plates of tissue are bombarded. Each plate is made from two flasks.

To prepare gold particles for bombardment, 30 mg gold is washed in ethanol, centrifuged and resuspended in 0.5 ml of sterile water. For each plasmid combination (treatments) to be used for bombardment, a separate micro-centrifuge tube is prepared, starting with 50 μl of the gold particles prepared above. Into each tube, the following are also added; 5 μl of plasmid DNA (at 1 μg/μl), 50 μl CaCl2, and 20 μl 0.1 M spermidine. This mixture is agitated on a vortex shaker for 3 minutes, and then centrifuged using a microcentrifuge set at 14,000 RPM for 10 seconds. The supernatant is decanted and the gold particles with attached, precipitated DNA are washed twice with 400 μl aliquots of ethanol (with a brief centrifugation as above between each washing). The final volume of 100% ethanol per each tube is adjusted to 40 μl, and this particle/DNA suspension is kept on ice until being used for bombardment.

Immediately before applying the particle/DNA suspension, the tube is briefly dipped into a sonicator bath to disperse the particles, and then 5 μL of DNA prep is pipetted onto each flying disk and allowed to dry. The flying disk is then placed into the DuPont Biolistics PDS1000/HE. Using the DuPont Biolistic PDS1000/HE instrument for particle-mediated DNA delivery into soybean suspension clusters, the following settings are used. The membrane rupture pressure is 1100 psi. The chamber is evacuated to a vacuum of 27-28 inches of mercury. The tissue is placed approximately 3.5 inches from the retaining/stopping screen (3rd shelf from the bottom). Each plate is bombarded twice, and the tissue clusters are rearranged using a sterile spatula between shots.

Following bombardment, the tissue is re-suspended in liquid culture medium, each plate being divided between 2 flasks with fresh SB196 or SB172 media and cultured as described above. Four to seven days post-bombardment, the medium is replaced with fresh medium containing a selection agent. The selection media is refreshed weekly for 4 weeks and once again at 6 weeks. Weekly replacement after 4 weeks may be necessary if cell density and media turbidity is high.

Four to eight weeks post-bombardment, green, transformed tissue may be observed growing from untransformed, necrotic embryogenic clusters. Isolated, green tissue is removed and inoculated into 6-well microtiter plates with liquid medium to generate clonally-propagated, transformed embryogenic suspension cultures.

Each embryogenic cluster is placed into one well of a Costar 6-well plate with 5 mls fresh SB196 media with selection agent. Cultures are maintained for 2-6 weeks with fresh media changes every 2 weeks. When enough tissue is available, a portion of surviving transformed clones are subcultured to a second 6-well plate as a back-up to protect against contamination.

To promote in vitro maturation, transformed embryogenic clusters are removed from liquid SB196 and placed on solid agar media, SB 166, for 2 weeks. Tissue clumps of 2-4 mm size are plated at a tissue density of 10 to 15 clusters per plate. Plates are incubated in diffuse, low light (<10 μE) at 26+/−1° C. After two weeks, clusters are subcultured to SB 103 media for 3-4 weeks.

SB 166 is prepared as follows: (per liter), 1 pkg. MS salts (Gibco/BRL—Cat #11117-017), 1 ml B5 vitamins 1000× stock, 60 g maltose, 750 mg MgCl2 hexahydrate, 5 g activated charcoal, pH 5.7, 2 g gelrite. SB 103 media is prepared as follows: (per liter), 1 pkg. MS salts (Gibco/BRL—Cat #11117-017), 1 ml B5 vitamins 1000× stock, 60 g maltose, 750 mg MgCl2 hexahydrate, pH 5.7, 2 g gelrite. After 5-6 week maturation, individual embryos are desiccated by placing embryos into a 100×15 petri dish with a 1 cm2 portion of the SB103 media to create a chamber with enough humidity to promote partial desiccation, but not death.

Approximately 25 embryos are desiccated per plate. Plates are sealed with several layers of parafilm and again are placed in a lower light condition. The duration of the desiccation step is best determined empirically, and depends on size and quantity of embryos placed per plate. For example, small embryos or few embryos/plate require a shorter drying period, while large embryos or many embryos/plate require a longer drying period. It is best to check on the embryos after about 3 days, but proper desiccation will most likely take 5 to 7 days. Embryos will decrease in size during this process.

Desiccated embryos are planted in SB 71-1 or MSO medium where they are left to germinate under the same culture conditions described for the suspension cultures. When the plantlets have two fully-expanded trifoliate leaves, germinated and rooted embryos are transferred to sterile soil and watered with MS fertilizer. Plants are grown to maturity for seed collection and analysis. Healthy, fertile transgenic plants are grown in the greenhouse.

SB 71-1 is prepared as follows: 1 bottle Gamborg's B5 salts w/sucrose (Gibco/BRL—Cat #21153-036), 10 g sucrose, 750 mg MgCl2 hexahydrate, pH 5.7, 2 g gelrite. MSO media is prepared as follows: 1 pkg Murashige and Skoog salts (Gibco 11117-066), 1 ml B5 vitamins 1000× stock, 30 g sucrose, pH 5.8, 2 g Gelrite.

C. Transformation of Maize Using *Agrobacterium*

*Agrobacterium*-mediated transformation of maize is performed essentially as described by Zhao et al., in *Meth. Mol. Biol.* 318:315-323 (2006) (see also Zhao et al., *Mol. Breed.* 8:323-333 (2001) and U.S. Pat. No. 5,981,840 issued Nov. 9, 1999, incorporated herein by reference). The transformation process involves bacterium inoculation, co-cultivation, resting, selection and plant regeneration.

1. Immature Embryo Preparation:

Immature maize embryos are dissected from caryopses and placed in a 2 mL microtube containing 2 mL PHI-A medium.

2. *Agrobacterium* Infection and Co-Cultivation of Immature Embryos:

2.1 Infection Step:

PHI-A medium of (1) is removed with 1 mL micropipettor, and 1 mL of *Agrobacterium* suspension is added. The tube is gently inverted to mix. The mixture is incubated for 5 min at room temperature.

2.2 Co-Culture Step:

The *Agrobacterium* suspension is removed from the infection step with a 1 mL micropipettor. Using a sterile spatula the embryos are scraped from the tube and transferred to a plate of PHI-B medium in a 100×15 mm Petri dish. The embryos are oriented with the embryonic axis down on the surface of the medium. Plates with the embryos are cultured at 20° C., in darkness, for three days. L-Cysteine can be used in the co-cultivation phase. With the standard binary vector, the co-cultivation medium supplied with 100-400 mg/L L-cysteine is critical for recovering stable transgenic events.

3. Selection of Putative Transgenic Events:

To each plate of PHI-D medium in a 100×15 mm Petri dish, 10 embryos are transferred, maintaining orientation and the dishes are sealed with parafilm. The plates are incubated in darkness at 28° C. Actively growing putative events, as pale yellow embryonic tissue, are expected to be visible in six to eight weeks. Embryos that produce no events may be brown and necrotic, and little friable tissue growth is evident. Putative transgenic embryonic tissue is subcultured to fresh PHI-D plates at two-three week intervals, depending on growth rate. The events are recorded.

4. Regeneration of T0 Plants:

Embryonic tissue propagated on PHI-D medium is subcultured to PHI-E medium (somatic embryo maturation medium), in 100×25 mm Petri dishes and incubated at 28° C., in darkness, until somatic embryos mature, for about ten to eighteen days. Individual, matured somatic embryos with well-defined scutellum and coleoptile are transferred to PHI-F embryo germination medium and incubated at 28° C. in the light (about 80 µE from cool white or equivalent fluorescent lamps). In seven to ten days, regenerated plants, about 10 cm tall, are potted in horticultural mix and hardened-off using standard horticultural methods.

Media for Plant Transformation:

1. PHI-A: 4 g/L CHU basal salts, 1.0 mL/L 1000× Eriksson's vitamin mix, 0.5 mg/L thiamin HCl, 1.5 mg/L 2,4-D, 0.69 g/L L-proline, 68.5 g/L sucrose, 36 g/L glucose, pH 5.2. Add 100 µM acetosyringone (filter-sterilized).
2. PHI-B: PHI-A without glucose, increase 2,4-D to 2 mg/L, reduce sucrose to 30 g/L and supplemented with 0.85 mg/L silver nitrate (filter-sterilized), 3.0 g/L Gelrite®, 100 µM acetosyringone (filter-sterilized), pH 5.8.
3. PHI-C: PHI-B without Gelrite® and acetosyringonee, reduce 2,4-D to 1.5 mg/L and supplemented with 8.0 g/L agar, 0.5 g/L 2-[N-morpholino]ethane-sulfonic acid (MES) buffer, 100 mg/L carbenicillin (filter-sterilized).
4. PHI-D: PHI-C supplemented with 3 mg/L bialaphos (filter-sterilized).
5. PHI-E: 4.3 g/L of Murashige and Skoog (MS) salts, (Gibco, BRL 11117-074), 0.5 mg/L nicotinic acid, 0.1 mg/L thiamine HCl, 0.5 mg/L pyridoxine HCl, 2.0 mg/L glycine, 0.1 g/L myo-inositol, 0.5 mg/L zeatin (Sigma, Cat. No. Z-0164), 1 mg/L indole acetic acid (IAA), 26.4 µg/L abscisic acid (ABA), 60 g/L sucrose, 3 mg/L bialaphos (filter-sterilized), 100 mg/L carbenicillin (filter-sterilized), 8 g/L agar, pH 5.6.
6. PHI-F: PHI-E without zeatin, IAA, ABA; reduce sucrose to 40 g/L; replacing agar with 1.5 g/L Gelrite®; pH 5.6.

Plants can be regenerated from the transgenic callus by first transferring clusters of tissue to N6 medium supplemented with 0.2 mg per liter of 2,4-D. After two weeks the tissue can be transferred to regeneration medium (Fromm et al., *Bio/Technology* 8:833-839 (1990)).

Transgenic T0 plants can be regenerated and their phenotype determined. T1 seed can be collected.

Furthermore, a recombinant DNA construct containing a validated *Arabidopsis* gene can be introduced into a maize inbred line either by direct transformation or introgression from a separately transformed line.

Transgenic plants, either inbred or hybrid, can undergo more vigorous field-based experiments to study expression effects.

Example 2

Isolation of Small RNAs for MPSS or 454 Sequencing

RNA samples were extracted using Trizol reagent (Invitrogen), from the following tissues: drought-stressed maize leaves, well-watered maize leaves, unfertilized maize ovules, early stage maize kernels (2 days after pollination), mixed later stages maize kernels (7, 14 and 21 days after pollination). Total RNA was fractionated on 15% polyacrylamide TBE/urea gels, and a 21-nt RNA marker was also included in a separate lane. Following electrophoresis, the gels were stained with ethidium bromide, and the region of the gel corresponding to 20-22 nucleotides was excised. The small RNA fraction was eluted overnight, ethanol precipitated, and then ligated sequentially to 5' and 3' RNA adaptors, using T4 RNA ligase (5' RNA adaptor GGUCUUAGUCGCAUCCU-GUAGAUGGAUC and 3' RNA adaptor pAUGCA-CACUGAUGCUGACACCUGCidT where p=phosphate; idT=inverted deoxythymidine; SEQ ID NOs:8428 and 8429, respectively). The products of each ligation were gel purified on 10% denaturing polyacrylamide gels, to remove unligated adaptors. RT-PCR was then carried out on the final ligation product, using primers complementary to the 5' and 3' adaptor sequences. Amplified cDNAs corresponding to small RNAs were sequenced using one of three methods: concatamerization followed by standard dideoxy sequencing (Elbashir et al., 2001 *Genes & Dev.* 15: 188-200), Massively Parallel Signature Sequencing (MPSS™) tag sequencing (Solexa) or 454™ sequencing (454 Life Sciences), or small RNA sequencing by SBS (Sequencing-By-Synthesis; Illumina™ Inc. San Diego, Calif.).

Example 3

Identification of Maize miRNA Sequences

Experimental data are analyzed by a program called "mirna", referred to as "the program". The program is written in the Perl programming language. It runs mainly from a CGI web interface, but also can be run from the command line.

For any particular combination of *Zea mays* genomic data and experimental results, experimental sequence data from MPSS or 454 sequencing is located in a maize genomic database; those which show a match between experimental sequence and genomic sequences are called "tags". A mixture of proprietary and public genomic data are assembled into a set of contigs. Any non-contiguous genomic sequence or unassembled genomic sequence is searched separately. In addition, data derived from B73 and MO17 cultivars are kept separate. All subsequent analysis is performed only on tags identified by matching sequences from the small RNA MPSS or 454 experiments to sequences located in the genomic databases.

A selectable series of screens is applied to these tags to determine computationally which tags are likely to represent miRNAs. Each screen can be selected or skipped by the user running the analysis. The screens include: removing tags found in repeat regions; removing tags that match known RNA; combining tags that have significant overlap in the genomic data; removing tags that match published known miRNAs; removing tags that appear near each other in clusters; removing tags that have a low PPM (parts-per-million, a measure of frequency) value in the experimental data; removing tags that do not have an easily identifiable base-pairing sequence nearby in the genome; and testing the region of the genome surrounding the tag for good RNA folding characteristics.

The RNA folding tests are performed by first employing a publicly available RNA folding algorithm (Vienna RNA Package) on a 500 bp region of the genome containing the tag. Regions that do not fold according to the default parameters (including a Gibbs free energy of −30 ΔG; Hofacker et al. 1994 Monatsh. Chem. 125: 167-188) are removed from further consideration. A selectable series of tests are employed with adjustable parameters to identify those tags whose folds appear to be miRNA precursors. These parameters include several restrictions on the size and number of mismatched basepairs in the putative fold; the size and conformation of the hairpin region of the fold; matching characteristics of certain bases commonly found in miRNAs; and the folding characteristics of the region adjacent to the miRNA precursor.

The set of tags which pass these computational screens are then examined in several graphic displays that represent the fold, the putative miRNA, and the detailed results of the folding tests and other experimental results. This examination may result in a tag being rejected by an expert that had passed the computational screens. Additional computational screens that are suggested by these expert examinations may then be incorporated into the program.

The biological validity of the miRNA sequences is further tested by using WU-BLAST (Gish, Washington University at St. Louis; Altschul et al 1990 *J Mol Biol* 215:403-410) analysis to identify the putative genomic targets. Given the incomplete nature of the maize genome tags are not rejected on the basis of this target examination. However, computational identification of a target increases the likelihood that the miRNA sequence is biologically active. A combination of rice and maize genomic data are used in the identification of putative targets.

Example 4

Maize miRNA Sequences

The protocol outlined in Example 3 was employed on maize RNA isolated from the following maize tissues: drought-stressed maize leaves, well-watered maize leaves, unfertilized maize ovules, early stage maize kernels (2 days after pollination), mixed later stages maize kernels (7, 14 and 21 days after pollination).

Analysis yielded 2808 maize microRNA sequences (see Table 1 showing SEQ ID NOs:1-2652 found in U.S. Provisional Application No. 60/849,672, filed Oct. 5, 2006, and 156 additional microRNA sequences added herein SEQ ID NOs:7959-8114).

Known miRNA sequences were excluded from this list. Many of the known miRNA sequences were found to be abundantly represented in the sequenced libraries and were identified by the protocol outlined in this application. Known miRNA sequences were not limited to maize, even though the starting RNAs were all from maize. Therefore, it is expected that the 2808 miRNA sequences from maize disclosed in this application is a population enriched for maize-specific and lower abundance miRNA species. It should be noted that "lower abundance" is a relative term and the absolute amount of any given microRNA sequence in any given tissue or developmental state may be widely variable.

Example 5

Expression Analysis of Maize miRNAs

Expression analysis can be used to provide further evidence that a given small RNA sequence corresponds to a miRNA. The ability to detect a miRNA by Northern blotting and hybridization is a standard criterion used by researchers to validate candidate miRNAs (Ambros et al., 2003). Alternatively, RT-PCR protocols have been developed that allow detection of small RNAs that are of lower abundance (Shi and Chiang, 2005; Chen et al., 2005). We will use one or both of these procedures to validate selected candidate miRNAs from our list. In addition, most if not all of the miRNA candidates we are disclosing will be included as features on a microarray chip, which will allow hybridization to small RNA fractions of a variety of tissues and treatments. Expression profiling of miRNAs by microarray analysis is a rapidly evolving and robust technology that should allow further validation of candidate miRNAs, as well as provide information on tissue specificity and/or conditional expression of particular miRNAs.

Particular miRNA candidates may have clearly recognizable target transcripts based on bioinformatic analysis, which provides an opportunity for further validation of the miRNAs. Modified RACE-PCR on putative targets of selected miRNA candidates will be used to identify RISC cleavage products with a 5' terminus located at the center of the putative target site of the miRNA (Llave et al., 2002). This result would strongly suggest that a given candidate miRNA enters into a RISC complex, and thus functions as would be expected for a bona fide miRNA.

Functional studies will be initiated on selected miRNAs with expression patterns and/or targets of agronomic interest, for example drought-induced or kernel-specific miRNAs. To determine the in planta function of selected miRNAs, the miRNA can be overexpressed by fusing a sequence (either cDNA or genomic) encompassing the hairpin precursor of the miRNA, plus a minimal amount of flanking sequence, to a constitutive promoter (e.g. the maize Ubiquitin promoter) and creating transgenic maize lines with this construct. Depending on the agronomic trait being studied, phenotyping can be carried out on independent T0 individuals overexpressing the miRNA. In addition, the effects of miRNA overexpression on the relevant target genes can be assessed by Northern blot and/or RT-PCR, to confirm that a predicted target is in fact a bona fide target. An independent demonstration that a given miRNA controls the expression of a given target gene is to mutate the target site present within the target gene (without changing amino acid sequence), and retransform the "miRNA-resistant" version of the target gene. This approach allows one to assess the phenotype conferred by loss of miRNA regulation, which in the majority of cases cannot be assessed by direct knockout of the miRNA (due to genetic redundancy and/or lack of an available knockout line).

Example 6

Validation of Small RNAs by Expression Profiling

Because the number of disclosed candidate miRNAs number in the thousands, validation must be performed using high-throughput procedures. Microarray technology is useful for this purpose. The flexibility and reliability of microarrays is well documented (Davison et al. (2006), *Methods in Enzymology* 411: 14-34; Axtell and Bartel (2005), *Plant Cell* 17: 1658-1673), as is their suitability for assaying the expression of many different tissues and conditions. The specific protocols for small RNA hybridization to microarrays have been available for the past couple of years. Microarrays are constructed to represent the candidate miRNAs, as well as known miRNAs already in the literature. Hybridization is carried out with labeled small RNA fractions purified from a variety of maize tissues, including different organs such as roots, leaves and flowers, and including environmental variables such as drought/pathogen stress and low nutrients. Statistical analysis of hybridization data allows one to identify candidate miRNAs displaying significant expression, and in this manner validate endogenous expression. This profiling approach also provides initial clues regarding the in vivo function of particular miRNAs, especially if their expression is tissue-specific or environmentally regulated. Further validation would involve Northern blot analysis and/or qRT-PCR on promising candidates (see Example 8).

Small RNA expression is analyzed by hybridization to a custom-designed plant miRNA expression array. Arrays are synthesized by Agilent technologies in the 2-pack 11,000 feature format. Known miRNA and candidate miRNA sequences from multiple species are represented by a series of specially designed reporter oligos. Reporters containing 0, 1 or 2 mismatches to the target sequence are designed in both the sense and antisense orientations. In addition, a duplexed reporter is added that contained two tandem copies of the antisense target sequence. Antisense duplexed and 0-mismatch reporters are used to detect miRNA expression. Antisense 1- and 2-mismatch reporters provide information on reporter specificity. Sense reporter data aids in differentiating miRNAs from small-interfering RNAs.

Total RNA is prepared using Trizol reagent (Invitrogen) and enriched for small RNAs (<200 nt) using glass fiber filters (miRvana small RNA isolation kit, Ambion). Small RNA samples are directly labeled with Cy-5 (Label IT miRNA labeling kit, Mirus Bio). Four micrograms of labeled RNA is hybridized to the custom arrays at 50° C. Hybridization, washing, scanning and feature extraction protocols follow the Agilent One-Color Microarray-Based Gene Expression Analysis protocols. To ensure reproducibility and reliability, samples are analyzed in triplicate. Data are analyzed using Rosetta Resolver, Spotfire DecisionSite, and customized spot-calling and error calculation programs.

Small RNAs are determined to be expressed if, for all three samples, the antisense duplex and O-mismatch reporters register intensities more than two standard deviations above background, but other reporters register signals at or below background intensity. These sequences are moved forward for additional validation by other techniques such as small RNA Northern blotting (Plant Cell. 2003; 15(11): 2730-2741), in-gel miRNA detection (miR-tect-IT miRNA labeling and detection kit, USB Corporation), custom Taqman miRNA assays (Applied Biosystems), and poly-adenylation assisted RT-PCR.

Example 7

Validation of Small RNAs by Expression Profiling

Tissue Source and RNA Extractions

Table 2 lists the genotypes, growth conditions and developmental stages of tissues harvested for expression profiling.

TABLE 2

| Growth and harvest conditions for profiled samples | | | | | |
|---|---|---|---|---|---|
| Sample Name | Tissue | Genotype | Stage | Growth condition | Experimental Condition |
| B73 Leaf | Leaf | B73 | VT | pot grown; screen house: Newark, DE | Tissue survey |
| Ear | Immature ear | B73 | VT | pot grown; screen house: Newark, DE | Tissue survey |
| B73 Seedling | Aerial seedling | B73 | V4 | germination paper in water; growth chamber (28 C., 14 hours light, 10 hours dark) | Tissue survey |
| 3245 Normal Nitrogen | Leaf | 3245 | V18 | field grown: Johnston, IA | Normal nitrogen |
| 3245 Low Nitrogen | Leaf | 3245 | V18 | field grown: Johnston, IA | Low nitrogen |
| 33B50 Normal Nitrogen | Leaf | 33B50 | V18 | field grown: Johnston, IA | Normal nitrogen |
| B73 Low Nitrogen | Leaf | B73 | V18 | pot grown, greenhouse | Low Nitrogen |

Harvested tissues were immediately frozen in liquid nitrogen and stored at −80 C. Tissues were homogenized to powder form while kept frozen. Total RNA was isolated from 2-5 grams of homogenized tissue by organic extraction using the manufacturer's protocol for Trizol™ Reagent (Invitrogen; Carlsbad, Calif.) or the E.Z.N.A. DNA/RNA Isolation System™ (Omega Bio-Tek; Doraville, Ga.). A fraction enriched for RNA molecules under 200 nucleotides in length was isolated from 100 micrograms total RNA using the mirVana™ miRNA Isolation Kit (Ambion; Austin Tex.), protocol IV.A: Isolation of small RNAs from total RNA samples. The total RNA and small RNA samples were analyzed on an RNA 6000 Nano Chip and Small RNA Chip (2100 Bioanalyzer, Agilent Technologies) respectively to determine the quality and concentration of the sample.

Array Design

Custom gene expression microarrays were manufactured by Agilent Technologies in the 4×44 k format. Each sixty nucleotide probe encoded two tandem bait sequences separated by a three nucleotide spacer and followed by 15 nucleotides of Agilent's generic spacer sequence. Guanine residues preceded each bait sequence. The overall probe design followed the format: 5'-G[BAIT]$_{21nt}$ATAG[BAIT]$_{21nt}$GCGTTCCGTATGTGG-3'.

Three probes were designed for each small RNA assayed: perfectly sequence matched probes (0MM) used bait sequences antisense to the query sequence; single mismatch probes (1MM) used antisense query sequences with a substitution at the tenth position from the 5' end of the sense query sequence as bait; double mismatch probes (2MM) used antisense query sequences with substitutions at the seventh and fifteenth positions from the 5' end of the sense query sequence as bait. Substitutions were made by replacing A with T, T with A, G with C, and C with G.

Small RNA Labeling

Prior to labeling, an aliquot of a spike-in control cocktail was added to 5 micrograms of each small RNA sample. Direct labeling of the RNA was achieved by incubating four micrograms of each sample with 4 microliters of the LabelIT Cy3 Reagent according to the LabelIT miRNA Labeling Kit protocol (Mirus Bio Corporation; Madison Wis.). The samples were subsequently quantitated with a spectrophotometer to measure concentration and Cy3 incorporation rates.

Array Hybridization

Each sample was hybridized to a custom Agilent oligonucleotide array overnight at 50 C in a rotating hybridization oven. The microarray slides were hybridized and washed according to Agilent Technologies One-Color Microarray-Based Gene Expression Analysis Protocol and immediately scanned with Agilent's DNA Microarray Scanner at two laser settings (100% and 10% PMT).

Data Analysis

The images were visually inspected for image artifacts and feature intensities were extracted, filtered, and normalized with Agilent's Feature Extraction Software (version 9.5.3.1). Further quality control and downstream analysis was performed using data analysis tools in Rosetta's Resolver Database (NBIC Rosetta Resolver System).

Samples were assayed as biological duplicates or triplicates. Feature intensity data was combined and normalized among replicates and within experiments using a least squares method with weighted regression of error. A brief description of the statistical methods for analysis of the miRNA microarray data, were previously reported (Luck, (2001) *Proceedings of SPIE* 4266:153-157). The analysis is based on the vector space representations of fluorescence intensities for microarrays and miRNAs. The first stage of the analysis involves the normalization of microarray intensities to adjust for variations in instrumental response between replicates. The normalization parameters are estimated by applying weighted regression to characterize the covariance between replicates. The normalized intensities for the replicates are averaged to obtain an intensity for each miRNA probe for a given tissue. Intensities for replicates are correlated, consequently the miRNA vectors are distributed about a mean line with dimensionality equal to the number of replicates. The noise in the intensity measurements is estimated by analyzing the squared deviations of the replicate vectors from the mean line. A variance function is obtained by weighted quadratic regression of the squared deviations versus mean intensity. An empirical confidence interval can then be associated with each value of averaged intensity. The confidence interval characterizes the overall noise including biological and instrumental contributions. The confidence intervals are used to estimate the significance level of observed deviations from the mean and identify outlier vectors among the replicates. Similarly the significance level for differences between means is used to identify those miRNAs that show significant changes in hybridization due to mismatched probes. The t distribution was used to estimate p-values for the difference statistics with the degrees of freedom equal to the number of replicates.

The reproducibility of each normalized signal was determined by ANOVA or t-test calculations among the biological replicates of each sample. Sequences with replicate P-values above 0.05 were considered to be sufficiently reproducible.

A t-test was performed comparing the normalized signal for each probe to the background signal in that sample. A query sequence with a 0MM-background P-value less than 0.05 was considered to be expressed significantly above background.

Two calculations were used to ensure the specificity of the 0MM signal for each query sequence. Again using the t-test, the 0MM normalized signal was compared pair-wise with the normalized signal for each of the query sequence's mismatch probes. Because P-values only indicate the significance of the difference between signals, but not which signal is greater, each 0MM signal was also required to be larger than both its cognate 1MM and 2MM signals. Any query sequence whose 0MM signal was larger than both of its cognate mismatch signals and whose 0MM-1MM and 0MM-2MM P-values were both less than 0.05 was considered to be show appropriate signal specificity. These criteria are summarized in Table 3.

TABLE 3

Criteria used to determine the reliable detection of query sequences.

| Value | Criteria |
| --- | --- |
| 0 MM replicate P-value | >0.05 |
| 0 MM-background P-value | <0.05 |
| 0 MM-1 MM P-value | <0.05 |
| 0 MM-2 MM P-value | <0.05 |
| 0 MM-1 MM | >0 |
| 0 MM-2 MM | >0 |

Detection criteria were applied to each sample independently. Query sequences meeting all the criteria outlined above were considered to have been reliably detected by the expression array and were marked as "passed," "enriched," or "highly enriched" in Table 4. A query sequence was designated as "enriched" in a given sample if it met all reliable detection criteria and its 0MM signal intensity in that sample was between 5-fold and 10-fold above the 0MM intensity for any other sample in the same experiment. "Highly enriched" sequences met all reliable detection criteria and displayed 0MM signal intensity at least 10-fold above the 0MM intensity of any other sample in the same experiment. In the two experiments that contained only a single sample ("33B50 Normal Nitrogen" and "B73 Low Nitrogen") query sequences were analyzed only for meeting reliable detection criteria—no calls as to enrichment were made. 0MM intensity scores in arbitrary and reliable detection assessments are listed by sample for each query sequence in Table 4.

Expression profile results for the first 2652 maize microRNAs from Table 1 are summarized in Table 4.

Detection of Public Domain Zea mays miRNAs

Public domain Zea mays miRNAs were included among the query sequences for use as detection standards. Due to sequence redundancy among miRNA family members, the 116 maize miRNAs published at the time of array design were fully represented by 50 unique mature miRNA sequences (Griffiths-Jones, et al. Nuc Acids Res (2006) 34:D140-D144. Release 9.0; Zhang, et al. FEBS Lett. (2006) 580:3753-62; Sunkar, et al. The Plant Cell (2005) 17:1397-1411; Johnson, et al. Nuc Acids Res (2007) 35:D829-D833). Using the reliable detection criteria outline in Table 3, 88% of public domain miRNA sequences were detected in at least one sample.

Of the six public domain miRNA sequences that failed to meet reliable detection criteria in any sample, only miR437 and miR444 failed to surpass background noise. As miR437 expression has not been assayed in maize and miR444 expression in maize is known to be weak compared to its expression in rice, low signal strength for these sequences could be expected (Sunkar, et al. The Plant Cell (2005) 17:1397-1411). That only 4% of public domain miRNAs sequences failed to surpass background signal indicated an excellent signal to noise ratio within these datasets. MiR168a/b, miR390 and miR395a/b/c surpassed background but failed to show significant difference between 0MM and 1MM signals. Although the 0MM signal was above background and distinct from its cognate mismatches, 2MM signal for miR171g was consistently higher than its 0MM signal. For the four miRNA sequences lacking signal resolution, it was impossible to conclude whether the query sequence was absent and the 0MM signal indicated cross-hybridization or whether the query sequence was present in addition to a second sequence that specifically hybridized to the mismatch probe.

Many public domain miRNAs have detectable basal expression in nearly all tissues. (Johnson, et al. Nuc Acids Res (2007) 35:D829-D833). Consistent with this, 46% of public domain miRNAs were reliably detected in all samples tested. Within the tissue comparison experiment, 78% or more of the public domain miRNAs are present in any sample. Near-ubiquitous basal expression also accounts for so few public domain miRNAs being scored as "enriched" or "highly enriched" in a single tissue or experimental condition. The reliable detection of public domain miRNAs is summarized in Table 5.

TABLE 5

Summary of the reliable detection of public domain miRNAs.

| Sample | Pass all criteria | Simple Pass | Enriched | Highly Enriched |
|---|---|---|---|---|
| MAXIMUM POSSIBLE | 100% (50) | | | |
| B73 Leaf | 84% (42) | 84% (42) | 0% (0) | 0% (0) |
| B73 Ear | 78% (39) | 76% (38) | 2% (1) | 0% (0) |
| B73 Seedling | 82% (41) | 82% (41) | 0% (0) | 0% (0) |
| All tissues in survey | 74% (37) | | | |
| One or more tissues | 88% (44) | | | |

TABLE 5-continued

Summary of the reliable detection of public domain miRNAs.

| Sample | Pass all criteria | Simple Pass | Enriched | Highly Enriched |
|---|---|---|---|---|
| 3245 Normal Nitrogen | 70% (35) | 70% (35) | 0% (0) | 0% (0) |
| 3245 Low Nitrogen | 62% (31) | 62% (31) | 0% (0) | 0% (0) |
| Both samples | 62% (31) | | | |
| 33B50 Normal Nitrogen | 56% (28) | | | |
| B73 Low Nitrogen | 78% (39) | | | |
| All samples | 46% (23) | | | |
| One or more samples | 88% (44) | | | |

Detection of Candidate miRNA Sequences

The reliable detection criteria described in Table 3 were also applied to data from probes representing the 2652 candidate miRNAs disclosed in this application (see Table 6). Only 136 or 5.1% of these candidates were reliably detected in all seven samples. Because they were cloned or sequenced from small RNA libraries, the most abundant and widely expressed miRNAs would have been among the earliest to be detected and published. Accordingly, it is reasonable that the proportion of candidate miRNAs ubiquitously detected was much smaller than that for public domain miRNAs. In absolute terms, the full validation of 136 miRNAs would approximately double the known cadre of maize miRNAs.

Since the most abundant miRNAs are expected to have been discovered and published in early RNA library searches, candidates showing extremely robust 0MM intensity scores across all or most samples should be treated with caution. Because the direct labeling technique conjugates a fluorescent molecule to each guanine residue, longer sequences are generally brighter than short sequences. The size fractionation kit used in sample preparation enriched for small RNAs from 0-200 nucleotides. Accordingly, candidates with 0MM intensity scores above 20,000 in most samples may be artifacts caused by RNA species much larger than 21 nucleotides in length.

Forty-one candidate sequences, or 1.5%, were reliably detected as enriched or highly enriched in particular samples. Strong tissue- or condition-specific detection patterns suggest these candidates may be especially useful in targeted gene silencing.

B73 was one of the maize strains used in the MPSS deep sequencing experiments that yielded the 2652 candidate miRNAs. The tissue survey samples used in the array analysis were also from B73 plants, as was an unpaired low nitrogen sample. Public domain and candidate miRNAs met reliable detection standards at higher rates in B73 samples than in other genotypes. Because public domain miRNAs showed differing pass rates between B73 and other genotypes, some of the discrepancy may be attributed to differences in growth conditions or sample handling. Nonetheless, candidate miRNAs showed a much greater disparity in reliable detection between B73 and other genotypes, raising the possibility that miRNAs can be differentially expressed in distinct genetic backgrounds.

TABLE 6

Summary of the reliable detection of candidate miRNAs.

| Sample | Pass all criteria | Simple Pass | Enriched | Highly Enriched |
|---|---|---|---|---|
| MAXIMUM POSSIBLE | 100.0% (2652) | | | |
| B73 Leaf | 31.7% (841) | 31.1% (824) | 0.1% (3) | 0.5% (14) |
| B73 Ear | 62.0% (1645) | 61.3% (1626) | 0.8% (20) | 0.2% (6) |
| B73 Seedling | 42.2% (1120) | 42.2% (1118) | 0.1% (2) | 0.0% (1) |
| All tissues in survey | 27.6% (731) | | | |
| One or more tissues | 64.9% (1722) | | | |
| 3245 Normal Nitrogen | 12.9% (343) | 12.9% (342) | 0.0% (0) | 0.0% (1) |
| 3245 Low Nitrogen | 9.4% (250) | 9.4% (250) | 0.0% (0) | 0.0% (0) |
| Both samples | 9.2% (243) | | | |
| 33B50 Normal Nitrogen | 8.1% (216) | | | |
| B73 Low Nitrogen | 20.4% (540) | | | |
| All samples above | 5.1% (136) | | | |
| One or more samples | 65.6% (1739) | | | |

Example 8

Validation of Small RNAs by Poly-Adenylation Assisted RT-PCR

The miRNA expression array and analysis procedures described in Example 7 can be used to evaluate candidate miRNA detectability and expression levels in additional samples, including but not limited to: additional profiling of developmentally staged organs or tissues; tissues from mutant strains defective in miRNA and small RNA biogenesis; tissues from plants exposed to biotic stress such as pathogens, pests, or weed pressure; tissues from plants exposed to abiotic stresses such as drought, heat, or cold; and tissues from plants subjected to nutrient stress such as low nitrogen.

Candidates can be prioritized for individual characterization based on the number of samples in which they were reliably detected, the utility potential of putative targets, and temporal, spatial and conditional expression patterns. Well known characterization methods include, but are not limited to, quantitative RT-PCR, Northern blotting, in situ hybridization, reporter silencing assays, and modified 5' RACE on putative targets.

As an example, small RNAs are analyzed using a modified version of the Shi & Chiang protocol that allows for the amplification of RNA fragments that do not have native poly (A) tails (Biotechniques. 2005; 39(4):519-25). DNA is removed from total RNA samples prepared with Trizol reagent (Invitrogen) by digestion with recombinant DNaseI (Ambion). Following ethanol precipitation of the RNA, the material is poly-adenylated using E. coli Poly(A) polymerase (Poly(A) Tailing Kit, Ambion).

First-strand DNA synthesis is accomplished with SuperScriptIII reverse transcriptase and supplied poly(T) primers (GeneRacer Kit, Invitrogen). Subsequent amplification by end-point PCR uses low annealing temperatures (56° C.) and short extension times (30 seconds). The GeneRacer 3' Primer (GeneRacer Kit, Invitrogen) is used as reverse primer and a sense, DNA version of the small RNA of interest is used as a forward primer. The presence of the diagnostic ~81 mer PCR product is assessed by visualizing PCR products with ethidium bromide on 10% acrylamide TBE gels (Criterion gels, BioRad).

Example 9

Selective Regulation of Transgenes with MicroRNAs

Because each candidate miRNA has the potential to recognize and negatively regulate a complementary sequence (i.e. "target site"), it is believed that target sites for these candidate miRNAs will serve as useful cis-acting regulatory sequences in transgenic constructs (Parizotto et al. (2004) Genes Dev 18: 2237-2242). This is especially true when the miRNA displays a precise tissue-specific or conditional pattern of expression. For example, to express a particular gene of interest in the shoot but not in the root, the target site of a root-specific miRNA is fused to the coding sequence of said gene of interest. In this manner, even if the gene of interest is driven by a constitutive promoter, the transcript should only accumulate in the shoot and not in the root, because the endogenous root-specific miRNA will recognize the attached target site and silence the gene's expression in the root.

To test this idea, miRNAs displaying tissue-specific expression are identified (see Example 7). Ideally, biologically relevant targets can be found bioinformatically and validated by the RACE cleavage assay; however, a sequence that is perfectly complementary to the miRNA should also suffice. The sequence designated as target site is fused to the 5' or 3' end of a suitable reporter gene that is driven by a constitutive promoter, and transgenic plants are generated. A pattern of expression that is the opposite of the tissue-specific miRNA pattern is taken as evidence that the target site is working as a cis regulatory element. This type of cis regulation allows further refinement of transgene expression patterns, such that "leaky" promoters (e.g. with small amounts of gene expression in undesirable tissues or conditions) are fine tuned and true tissue-specificity is achieved.

One example of a miRNA that has a stage-specific pattern of expression is miR172. In young Arabidopsis seedlings, miR172 is undetectable, whereas in more mature seedlings it is at higher levels, and this higher expression persists after the transition to flowering (Aukerman and Sakai (2003) Plant Cell 15:2730-41). Addition of the miR172 target site to a heterologous gene in a transgenic construct should therefore allow the transgene to be turned on in early seedling development, and then downregulated later on. To test this concept, the target sequence for miR172 is fused to the 3' end of the coding sequence for coral reef yellow fluorescent protein (ZS-yellow, Clonetech). As a negative control, a mutated version of the miR172 target site is separately fused to ZS-yellow, and both gene cassettes are separately placed under the control of the constitutive 35S promoter in a standard binary vector. These constructs are transformed into *Arabidopsis* (ecotype Col-0), and also into the rdr6 mutant if the levels of transgene silencing (independent of miRNA regulation) are too high. The expected result is that levels of ZS-yellow will be high in young transgenic seedlings containing the ZS-yellow/wild-type target site, and much lower as the plants mature. On the other hand, transgenic plants containing the ZS-yellow/mutated target site should not display this stage-specific downregulation.

To extend this analysis to maize, a target site for one of the maize miRNAs in this application's sequence listing, (SEQ ID NO:116; 5'-TTAGATGACCATCAGCAAAC-3') is useful. This particular miRNA is expressed at high levels in maize endosperm, and at much lower levels in other tissues. The target gene is EB158863, and the target site has two mismatches with the miRNA at the 3' end of the miRNA. The target site is fused to the 3' end of ZS-yellow, and this construct is placed under the control of the maize ubiquitin promoter. The expression construct is inserted into a suitable vector for maize transformation. A negative control construct containing a mutated version of the target site is also be made. Both constructs are transformed into maize embryogenic callus, and transgenic plants are selected. The expected result is that the levels of ZS-yellow will be high in most parts of the plants that contain the ZS-yellow/wild-type target site, but much lower in the endosperm. On the other hand, transgenic plants containing the ZS-yellow/mutated target site should not display this endosperm-preferred downregulation.

A reciprocal result is also possible in these types of experiments. The enriched/highly enriched calls shown in Example 7 were based on condition specificity or enhancement. Therefore the summaries were weighted for detection versus no detection. It is just as likely that particular microRNAs are depleted in a specific tissue rather than being enhanced in a specific tissue. This would allow target genes to be generally repressed and then expressed in a limited fashion in those tissues where the particular microRNA is under-expressed.

In both experiments described above, a pattern of expression that is the opposite of the tissue-specific miRNA pattern will be taken as evidence that the target site under study is working as a cis regulatory element. Utilizing these novel cis elements in combination with a wide variety of promoter elements allows for expression of transgenes in very specific patterns or stages during plant growth and development. For example, this type of cis regulation by miRNA targets would allow further refinement of transgene expression patterns, such that "leaky" promoters (e.g. with small amounts of gene expression in undesirable tissues or conditions) could be fine tuned and true tissue-specificity could be achieved. It is also envisioned that multiple miRNA targets could be incorporated in concert on a single expressed transgene. Multiple miRNA targets with different patterns of regulation and control could impart novel modes of regulation on transgene expression.

Example 10

Transgene Abundance May Affect Regulation by MicroRNAs

To test the potential for combinatorial control of transgenes by multiple miRNAs, the following experiment was performed. The ZS-yellow coding region was separately fused to either a target sequence for AtmiR827 at the 5' end, or to a target sequence for AtmiR397 at the 3' end ("single site constructs"). In a third construct, both target sequences were fused to ZS-yellow coding sequence, in the same positions as the single site constructs, thus creating a "double site construct." Previous data showed that AtmiR827 was specifically expressed in hydathodes, based upon analyses of AtmiR827 promoter-GUS histochemical assays. Therefore, a single site transgene construct containing the target site for AtmiR827 would be under the control of the endogenous miRNA, and might be expected to give rise to reduced expression of the transgene in hydathodes, when compared to a "no site" control construct. Likewise, microarray analysis had suggested that AtmiR397 was preferentially expressed in the root, and therefore a construct containing the target site for AtmiR397 might be expected to give rise to reduced expression of the transgene in the root, when compared to a "no site" control. The double site construct might be expected to behave as the sum of both single site constructs, giving rise to reduced expression in both the hydathode and root.

All three modified ZS-yellow sequences were separately placed under the control of the constitutive 35S promoter, and an unmodified ZS-yellow sequence was also separately fused to 35S as the "no site" control, in the binary vector pBC (Promega; Madison, Wis.). Both single site constructs, the double site construct, and the "no site" control construct were transformed into *Arabidopsis* using "floral dip" transformation (Clough and Bent (1998) *Plant J* 16:735-43) and T1 seeds were identified that expressed YFP from the ZS-yellow transgene. The T1 seeds were germinated on agar plates, and monitored for YFP expression starting at 5 days after germination. There were no observed differences in the expression pattern between the four constructs. More specifically, there was no observed reduction of YFP expression in the hydathodes in plants containing ZS-yellow fused to the target site for AtmiR827, nor was there a reduction of YFP expression in the roots of plants containing ZS-yellow fused to the target site for AtmiR397, when compared to ZS-yellow alone. Plants containing both sites fused to ZS-yellow likewise showed no effect relative to ZS-yellow alone. It is possible that the levels of endogenous AtmiR827 and AtmiR397 are too low relative to the levels of target-linked ZS-yellow to have achieved the desired downregulation in the relevant tissues. Both miRNAs are in general not very abundant, compared to commonly studied miRNAs like miR171 or miR156; whereas the target gene sequences in this experiment were driven by a strong viral promoter (35S). It should be noted that the only group that has reported transgene downregulation mediated by an endogenous miRNA (Parizotto et al. (2004) *Genes Dev* 18: 2237-2242) utilized miR171, a highly abundant miRNA, to downregulate a 35S-driven transgene containing the cognate target site.

Example 11

Selective Regulation of Transgenes with MicroRNAs of Comparable Abundance

YFP transcripts incorporating AtmiR827 and Atmir397 target sites may not have exhibited altered expression due to the extremely low abundance of those miRNAs in planta, especially when compared to the high levels of YFP mRNA likely produced by the 35S promoter. Therefore, target sites from more abundant miRNAs might circumvent this potential problem. To this end, the ZS-yellow coding region can be separately fused to either a target sequence for AtmiR171 at the 5' end, or to a target sequence for AtmiR156 at the 3' end ("single site constructs"). In a third construct, both target sequences will be fused to ZS-yellow coding sequence, in the same positions as the single site constructs, thus creating a "double site" construct. Both AtmiR171 and AtmiR156 are relatively abundant microRNAs, and are expressed in a variety of tissues. In the gynoecium, AtmiR171 is expressed in the carpel valves but absent from the replum, style and stigma; this pattern is reciprocal to that seen for a reporter construct ("sensor construct") containing the AtmiR171 target site (Parizotto et al. (2004) *Genes Dev* 18: 2237-2242). In contrast, AtmiR156 expression in the gynoecium is limited to the style (Rebecca Schwab, 2006, thesis from University of Tubingen), and thus the single site construct containing an AtmiR156 target site fused to ZS-yellow should have YFP expression in all parts of the gynoecium except the style. The double site construct with ZS-yellow would be expected to give rise to YFP expression only in the areas where both miRNAs are absent, i.e. the replum and stigma. One would expect the double site construct to behave as the sum of both single site constructs, with regards to YFP expression in the gynoecium.

Example 12

Trans-Acting miRNA Silencing

One can envision using tissue- or stage-specific miRNAs to silence a gene of interest only in a particular tissue or development stage of the organism, utilizing an artificial transacting sRNA (ta-sRNA) construct. The objective in this case is to generate artificial ta-siRNAs in a tissue- or stage-specific manner, by using a miRNA target corresponding to a tissue- or stage-specific miRNA as the trigger sequence ("trigger" refers to the target sequence that initiates production of the downstream ta-siRNAs). For example, if it were desired to silence a gene in the seeds of plants, one would choose as a trigger sequence the target sequence of a miRNA present only in the seeds. Such constructs are generated as follows:

A chimeric polynucleotide is constructed in which the target site for a tissue- or stage-specific miRNA is used as a trigger sequence and is operably linked to the 5' end of a silencer sequence. The silencer sequence comprises a synthetic DNA fragment containing 5 repeated copies of a 21 nucleotide segment complementary to the *Arabidopsis* fatty acid desaturase 2 (FAD2) gene with the sequence [5'-TTGCTTTCTTCAGATCTCCCA-3'; SEQ ID NO:7958]. The trigger sequence complementary to the miRNA is followed by 11 nucleotides such that the miRNA cleavage site is separated by 21 nucleotides from the first of the 21 nucleotide FAD2 segments. Sequences flanking the trigger and silencer are derived from the TAS1c locus (Allen et al. (2005) *Cell* 121:207-21). The 35S promoter and leader sequence (Odell (1985) *Nature* 313: 810-812) are attached to the 5' end of the chimeric construct and the phaseolin transcriptional terminator (Barr et al. (2004) *Molecular Breeding* 13: 345-356) to the 3' end. The entire chimeric polynucleotide is inserted into the standard binary vector pBE851 (Aukerman and Sakai (2003) *Plant Cell* 15:2730-41) and transformed into *Arabidopsis* using the method of Clough and Bent (1998) *Plant Journal* 16:735-43. As a control, the exact same construct is made but with 3 nucleotides of the miRNA target site mutated. Transgenic plants containing the experimental construct are monitored for silencing of the FAD2 gene using fatty acid analysis (Browse et al. (1986) *Analytical Biochemistry* 152: 141-145) and compared to control plants. Silencing may be scored as a detectable reduction in transcript level and/or a reduction in the gene products produced by those transcripts.

It is believed that any of the targets of microRNAs of the present invention could be useful as the tissue- or stage-specific trigger sequences. In addition, concatemers of miRNA sequences (such as those found in SEQ ID NO:7957 or SEQ ID NO:8427) are also useful as silencer sequences which would down-regulate their endogenous targets and/or the gene products of those targets in a pattern directed by the trigger sequence. Using different combinations of miRNA target sequences one could conceivably alter the expression patterns of multiple genes with a single construct.

SEQUENCE LISTING (8429 sequences)

SEQ ID NO: 1 - DNA, 21 bp, Zea mays
tagggctagtttgggagtcca

SEQ ID NO: 2 - DNA, 21 bp, Zea mays
gcggcttgctgcggctgcaat

SEQ ID NO: 3 - DNA, 21 bp, Zea mays
aaggccttgttcgtttgtatt

SEQ ID NO: 4 - DNA, 21 bp, Zea mays
gcgtgcaaggagccaagcatg

SEQ ID NO: 5 - DNA, 21 bp, Zea mays
gtgtcaaaaacaggtggtgga

SEQ ID NO: 6 - DNA, 21 bp, Zea mays
gacgacgacgacgatgaccca

SEQ ID NO: 7 - DNA, 21 bp, Zea mays
tgggctcggccttcttatata

SEQ ID NO: 8 - DNA, 21 bp, Zea mays
cggccggccggccggccgtca

SEQ ID NO: 9 - DNA, 21 bp, Zea mays
agatcagaaagagaccagagg

SEQ ID NO: 10 - DNA, 21 bp, Zea mays
ggcagtctccttggctagccc

SEQ ID NO: 11 - DNA, 21 bp, Zea mays
agaacagagcggctccgttcc

SEQ ID NO: 12 - DNA, 21 bp, Zea mays
atcggatgcaccagatcgctt

SEQ ID NO: 13 - DNA, 21 bp, Zea mays
tgtgccagaagcggcgatggg

SEQ ID NO: 14 - DNA, 21 bp, Zea mays
attcaaacccatccaatccca

SEQ ID NO: 15 - DNA, 21 bp, Zea mays
gagccagctcgttagctcgaa

SEQ ID NO: 16 - DNA, 21 bp, Zea mays
gtccgacacggccactgacag

SEQ ID NO: 17 - DNA, 21 bp, Zea mays
acgactaaccttaggcaaaat

SEQ ID NO: 18 - DNA, 21 bp, Zea mays
aggttgacgagattggccagg

SEQ ID NO: 19 - DNA, 21 bp, Zea mays
gagagctaaccgaacaagccc

SEQ ID NO: 20 - DNA, 21 bp, Zea mays
ggcaaagtgtggcaagttaac

SEQ ID NO: 21 - DNA, 21 bp, Zea mays
agggctaatttggtgattagg

SEQ ID NO: 22 - DNA, 21 bp, Zea mays
cggcacaaacgaacaaagtct

SEQ ID NO: 23 - DNA, 21 bp, Zea mays
caccgactgcaacccagctct

SEQ ID NO: 24 - DNA, 21 bp, Zea mays
taagtgccggtgggctcggcc

SEQ ID NO: 25 - DNA, 21 bp, Zea mays
cacaaacgaacaagacctcag

SEQ ID NO: 26 - DNA, 21 bp, Zea mays
cgccgcgccgggccgccgcca

SEQ ID NO: 27 - DNA, 21 bp, Zea mays
gggcctgtttggtttgtggct

SEQ ID NO: 28 - DNA, 21 bp, Zea mays
ggcaaagtgtggcaacttagg

SEQ ID NO: 29 - DNA, 21 bp, Zea mays
cgtcgtcggcgcggacgagag

SEQ ID NO: 30 - DNA, 21 bp, Zea mays
taggccctgtttggaagcaac

SEQ ID NO: 31 - DNA, 21 bp, Zea mays
cactcggcaaagagccaaaac

SEQ ID NO: 32 - DNA, 21 bp, Zea mays
ctttgccgagtgccagcgaca

SEQ ID NO: 33 - DNA, 21 bp, Zea mays
cagagctcccttcaatccaaa

SEQ ID NO: 34 - DNA, 21 bp, Zea mays
tacacttgtgacgtcaacata

SEQ ID NO: 35 - DNA, 21 bp, Zea mays
tgcacgtgccctgcttctcca

SEQ ID NO: 36 - DNA, 21 bp, Zea mays
aacaacatgatgtagttcaat

SEQ ID NO: 37 - DNA, 21 bp, Zea mays
cctattccctgtcattgagta

SEQ ID NO: 38 - DNA, 21 bp, Zea mays
ctgatttggtgaccagggatc

SEQ ID NO: 39 - DNA, 21 bp, Zea mays
ctggaccctatgctcgggact

SEQ ID NO: 40 - DNA, 21 bp, Zea mays
ggtgcaagcatgcaatcaaat

SEQ ID NO: 41 - DNA, 21 bp, Zea mays
aggagcccgacgtctgcatct

SEQ ID NO: 42 - DNA, 21 bp, Zea mays
tcgtcgtcaaccgccgccgcc

SEQ ID NO: 43 - DNA, 21 bp, Zea mays
gattgagagctaaccgaacaa

SEQ ID NO: 44 - DNA, 21 bp, Zea mays
gggcctgtttggtttgatggt

SEQ ID NO: 45 - DNA, 21 bp, Zea mays
gggcttcttcttgcgcaggcc

SEQ ID NO: 46 - DNA, 21 bp, Zea mays
cagtggcggacgcaggacgaa

SEQ ID NO: 47 - DNA, 21 bp, Zea mays
ggctcgggctctcagcgacgg

SEQ ID NO: 48 - DNA, 21 bp, Zea mays
cgaccgcctcctccggcacgg

SEQ ID NO: 49 - DNA, 21 bp, Zea mays
cggtgaggtcgttggcgctgt

SEQ ID NO: 50 - DNA, 21 bp, Zea mays
aggcagaaccaggggaggaag

SEQ ID NO: 51 - DNA, 21 bp, Zea mays
cacgcggcagtgcccaccccc

SEQ ID NO: 52 - DNA, 21 bp, Zea mays
ctctttgccgagtgccagcga

SEQ ID NO: 53 - DNA, 21 bp, Zea mays
acacaaacgaacaaggcctaa

SEQ ID NO: 54 - DNA, 21 bp, Zea mays
cttgcacgcttgcacataatg

SEQ ID NO: 55 - DNA, 21 bp, Zea mays
tgtcatggcttgtggctgaat

SEQ ID NO: 56 - DNA, 21 bp, Zea mays
gttgcaacgcacggacatata

SEQ ID NO: 57 - DNA, 21 bp, Zea mays
gttcgtttccgtcggattaca

SEQ ID NO: 58 - DNA, 21 bp, Zea mays
gttcgtttccgtcggattgga

SEQ ID NO: 59 - DNA, 21 bp, Zea mays
gggggtgtttggtttctagtg

SEQ ID NO: 60 - DNA, 21 bp, Zea mays
gagcagccaggctcccaaaaa

SEQ ID NO: 61 - DNA, 21 bp, Zea mays
gttggcgagcgaagcggagac

SEQ ID NO: 62 - DNA, 21 bp, Zea mays
aggagcagatgcagacgaggg

SEQ ID NO: 63 - DNA, 21 bp, Zea mays
ccacaaaccaaacaggccctt

SEQ ID NO: 64 - DNA, 21 bp, Zea mays
tgctcggcggcggcgtagcgc

SEQ ID NO: 65 - DNA, 21 bp, Zea mays
gtggcaagttaggcatcaaat

SEQ ID NO: 66 - DNA, 21 bp, Zea mays
tccagtcggttggcggcgatg

SEQ ID NO: 67 - DNA, 21 bp, Zea mays
ggtgcaagcatgcaatcaagc

SEQ ID NO: 68 - DNA, 21 bp, Zea mays
gccgactgccgtggagagcgc

SEQ ID NO: 69 - DNA, 21 bp, Zea mays
gtagcaacgcacgggcacatg

SEQ ID NO: 70 - DNA, 21 bp, Zea mays
caccagcggcgacgggaacct

SEQ ID NO: 71 - DNA, 21 bp, Zea mays
cagatcatgctggcagcttca

SEQ ID NO: 72 - DNA, 21 bp, Zea mays
tagtccctagaaaccaaacac

SEQ ID NO: 73 - DNA, 21 bp, Zea mays
tagctgatagttgcgtgagtt

SEQ ID NO: 74 - DNA, 21 bp, Zea mays
actggaccgcctgtgatgtgt

SEQ ID NO: 75 - DNA, 21 bp, Zea mays
aaagacactcggcaaagaaac

SEQ ID NO: 76 - DNA, 21 bp, Zea mays
aaaacactcggcaaagagctc

SEQ ID NO: 77 - DNA, 21 bp, Zea mays
ctttgccgagtgttttttctc

SEQ ID NO: 78 - DNA, 21 bp, Zea mays
tcggttacccgtgcgttgcga

SEQ ID NO: 79 - DNA, 21 bp, Zea mays
ttctcggccttttggctaaga

SEQ ID NO: 80 - DNA, 21 bp, Zea mays
cggctgacaaccgacgggaat

SEQ ID NO: 81 - DNA, 21 bp, Zea mays
tggatcagatggtttgcttgt

SEQ ID NO: 82 - DNA, 21 bp, Zea mays
cttgcaggtagaagccatcct

SEQ ID NO: 83 - DNA, 21 bp, Zea mays
agtgactgctgtattgctgtc

SEQ ID NO: 84 - DNA, 21 bp, Zea mays
cactcgacagtccaacccggt

SEQ ID NO: 85 - DNA, 21 bp, Zea mays
gggggtgtttggtttctaggg

SEQ ID NO: 86 - DNA, 21 bp, Zea mays
agtccctagaaaccaaacacc

SEQ ID NO: 87 - DNA, 21 bp, Zea mays
ctggccgccgaaaatgactgt

SEQ ID NO: 88 - DNA, 21 bp, Zea mays
cctccggttttgtggcttcca

SEQ ID NO: 89 - DNA, 21 bp, Zea mays
cagacgagcagcgagcggttt

SEQ ID NO: 90 - DNA, 21 bp, Zea mays
cgattccaggtgcaatccgac

SEQ ID NO: 91 - DNA, 21 bp, Zea mays
ttagccacgaaccaaacagcc

SEQ ID NO: 92 - DNA, 21 bp, Zea mays
caggctgtttgcagccccaca

SEQ ID NO: 93 - DNA, 21 bp, Zea mays
cgctggagcctggaggatcgt

SEQ ID NO: 94 - DNA, 21 bp, Zea mays
aacccagggcttccattacct

SEQ ID NO: 95 - DNA, 21 bp, Zea mays
gggtcacatcaagcgtttaac

SEQ ID NO: 96 - DNA, 21 bp, Zea mays
ggctcattccggtacaaccga

SEQ ID NO: 97 - DNA, 21 bp, Zea mays
cactatgtgtacaaacctaaa

SEQ ID NO: 98 - DNA, 21 bp, Zea mays
gatattggcacggctcaatca

SEQ ID NO: 99 - DNA, 21 bp, Zea mays
ttattataaccaaacacatcc

SEQ ID NO: 100 - DNA, 21 bp, Zea mays
gttaggcaaagtgtggcaagt

SEQ ID NO: 101 - DNA, 21 bp, Zea mays
gtcaaacgcttgatgtgaccc

SEQ ID NO: 102 - DNA, 21 bp, Zea mays
agatctagatcggatgcacca

SEQ ID NO: 103 - DNA, 21 bp, Zea mays
ggtcccgatctgcaccaagcg

SEQ ID NO: 104 - DNA, 21 bp, Zea mays
cactatgtgtacaaacctaag

SEQ ID NO: 105 - DNA, 21 bp, Zea mays
agtttctctctaaggtatgcc

SEQ ID NO: 106 - DNA, 21 bp, Zea mays
aatgacagaacgggatgagat

SEQ ID NO: 107 - DNA, 21 bp, Zea mays
tttttctacagtattttgtct

SEQ ID NO: 108 - DNA, 21 bp, Zea mays
agtggattaagatgtattgag

SEQ ID NO: 109 - DNA, 21 bp, Zea mays
tatctctatatcgtcggatct

SEQ ID NO: 110 - DNA, 21 bp, Zea mays
catgctggcagcttcactcat

SEQ ID NO: 111 - DNA, 21 bp, Zea mays
tagatcatgctggcagcttca

SEQ ID NO: 112 - DNA, 21 bp, Zea mays
aatattagaggcagcgcatac

SEQ ID NO: 113 - DNA, 21 bp, Zea mays
ctggcagctctgcttctgtcg

SEQ ID NO: 114 - DNA, 21 bp, Zea mays
ttaccgagtctgttagattag

SEQ ID NO: 115 - DNA, 21 bp, Zea mays
cagttcaagaaagcctgtgga

SEQ ID NO: 116 - DNA, 21 bp, Zea mays
ttagatgaccatcagcaaaca

SEQ ID NO: 117 - DNA, 21 bp, Zea mays
tggcttaaaagtgtggcgcgg

SEQ ID NO: 118 - DNA, 21 bp, Zea mays
agaatgttattgttaagcttc

SEQ ID NO: 119 - DNA, 21 bp, Zea mays
ggattggatcgaagggagctc

SEQ ID NO: 120 - DNA, 21 bp, Zea mays
catgctggcagcttcaccaac

SEQ ID NO: 121 - DNA, 21 bp, Zea mays
ggttcacaaaatgtaacgtaa

SEQ ID NO: 122 - DNA, 21 bp, Zea mays
gtggatttgtgtggccgtcat

SEQ ID NO: 123 - DNA, 21 bp, Zea mays
tagttaagccgtgtgataaat

SEQ ID NO: 124 - DNA, 21 bp, Zea mays
gatcaatgcgatccctttgga

SEQ ID NO: 125 - DNA, 21 bp, Zea mays
ccggcaagtcatccttggctg

SEQ ID NO: 126 - DNA, 21 bp, Zea mays
agagttgatgcagatctgatc

SEQ ID NO: 127 - DNA, 21 bp, Zea mays
ttagatcatgatccaaccgta

SEQ ID NO: 128 - DNA, 21 bp, Zea mays
ctctcatatggaaccaggcta

SEQ ID NO: 129 - DNA, 21 bp, Zea mays
atcttatgactggcaacggct

SEQ ID NO: 130 - DNA, 21 bp, Zea mays
atgcagcatcatcaagattct

SEQ ID NO: 131 - DNA, 21 bp, Zea mays
gttttttgacctatggattag

SEQ ID NO: 132 - DNA, 21 bp, Zea mays
gctaaaacgccttaacaacct

SEQ ID NO: 133 - DNA, 21 bp, Zea mays
cagttcaagaaagctgtggaa

SEQ ID NO: 134 - DNA, 21 bp, Zea mays
tggcatacaaggaatgagtat

SEQ ID NO: 135 - DNA, 21 bp, Zea mays
gttggatgtggagggtgtgat

SEQ ID NO: 136 - DNA, 21 bp, Zea mays
acggtcctctaaatttagatg

SEQ ID NO: 137 - DNA, 21 bp, Zea mays
acggtcctctaaatttagaga

SEQ ID NO: 138 - DNA, 21 bp, Zea mays
tcggataaaaccacgcctacc

SEQ ID NO: 139 - DNA, 21 bp, Zea mays
attgcacgtttgcaccaaaat

SEQ ID NO: 140 - DNA, 21 bp, Zea mays
agggctgcttggatggccact

SEQ ID NO: 141 - DNA, 21 bp, Zea mays
ataccccaaattcagggtgtt

SEQ ID NO: 142 - DNA, 21 bp, Zea mays
ggtagcttcgttaagctggcg

SEQ ID NO: 143 - DNA, 21 bp, Zea mays
gtgatggttaggtcgcagccc

SEQ ID NO: 144 - DNA, 21 bp, Zea mays
gagttcaggaaccaagtgaca

SEQ ID NO: 145 - DNA, 21 bp, Zea mays
ctgccgccacgtcccggctcg

SEQ ID NO: 146 - DNA, 21 bp, Zea mays
ttatgcttcgttgtgtacgaa

SEQ ID NO: 147 - DNA, 21 bp, Zea mays
gagcatggcatcataagcatt

SEQ ID NO: 148 - DNA, 21 bp, Zea mays
caggcttcgttgtctttattc

SEQ ID NO: 149 - DNA, 21 bp, Zea mays
acagcctatggcgccgagcta

SEQ ID NO: 150 - DNA, 21 bp, Zea mays
tagtccctagaaaccaaacat

SEQ ID NO: 151 - DNA, 21 bp, Zea mays
aaacgcttgatgtgacccggg

SEQ ID NO: 152 - DNA, 21 bp, Zea mays
gtgacccgggctaaactttag

SEQ ID NO: 153 - DNA, 21 bp, Zea mays
gtggactaaagtttagcccgg

SEQ ID NO: 154 - DNA, 21 bp, Zea mays
cacgagtcgagcgagctcacg

SEQ ID NO: 155 - DNA, 21 bp, Zea mays
gctagatagcggaccaacaga

SEQ ID NO: 156 - DNA, 21 bp, Zea mays
agttagccacgaaccaaacag

SEQ ID NO: 157 - DNA, 21 bp, Zea mays
tcacaaaaatgaggatagact

SEQ ID NO: 158 - DNA, 21 bp, Zea mays
atcggctatccatatccgtca

SEQ ID NO: 159 - DNA, 21 bp, Zea mays
ccgagctcggcgccatagatc

SEQ ID NO: 160 - DNA, 21 bp, Zea mays
ccatagatcttggcgccgagc

SEQ ID NO: 161 - DNA, 21 bp, Zea mays
tcgaggacgagctgcttatcc

SEQ ID NO: 162 - DNA, 21 bp, Zea mays
tagggctagtttgggagctca

SEQ ID NO: 163 - DNA, 21 bp, Zea mays
gaagcactcggcaaagctaga

SEQ ID NO: 164 - DNA, 21 bp, Zea mays
aagggtgcgtttggttgcaat

SEQ ID NO: 165 - DNA, 21 bp, Zea mays
cgactgctgcggtgcgccagg

SEQ ID NO: 166 - DNA, 21 bp, Zea mays
tggatcagatggtttgcttgc

SEQ ID NO: 167 - DNA, 21 bp, Zea mays
gagcttagcttggcccatgcg

SEQ ID NO: 168 - DNA, 21 bp, Zea mays
tgcgtttggttgcaatgacag

SEQ ID NO: 169 - DNA, 21 bp, Zea mays
agctgccgactcatccattca

SEQ ID NO: 170 - DNA, 21 bp, Zea mays
atcagaaagaggccagaggcc

SEQ ID NO: 171 - DNA, 21 bp, Zea mays
gcccgtctagctcagtcggta

SEQ ID NO: 172 - DNA, 21 bp, Zea mays
tgctgtttctctgcaggacaa

SEQ ID NO: 173 - DNA, 21 bp, Zea mays
gtgcggcggctcccagatccg

SEQ ID NO: 174 - DNA, 21 bp, Zea mays
ggcactatcaagcaggcacgg

SEQ ID NO: 175 - DNA, 21 bp, Zea mays
gggctcgagtccagccatacg

SEQ ID NO: 176 - DNA, 21 bp, Zea mays
attgcaaccatcagtatcatg

SEQ ID NO: 177 - DNA, 21 bp, Zea mays
ctttgccgagtgttttttgtc

SEQ ID NO: 178 - DNA, 21 bp, Zea mays
aaacgaacaaggcctaaggct

SEQ ID NO: 179 - DNA, 21 bp, Zea mays
cacaaacgaacaagaccttaa

SEQ ID NO: 180 - DNA, 21 bp, Zea mays
ttggcacggctcaatcagaga

SEQ ID NO: 181 - DNA, 21 bp, Zea mays
ttagctggaacgattccgtgt

SEQ ID NO: 182 - DNA, 21 bp, Zea mays
gaaagtcaaacgcttgatgtg

SEQ ID NO: 183 - DNA, 21 bp, Zea mays
aaaactttgttcccaaacagt

SEQ ID NO: 184 - DNA, 21 bp, Zea mays
aaggccttgttcgtttgggtc

SEQ ID NO: 185 - DNA, 21 bp, Zea mays
acggcgaaccagcaagcgaac

SEQ ID NO: 186 - DNA, 21 bp, Zea mays
aagcggaccctaagacaaaaa

SEQ ID NO: 187 - DNA, 21 bp, Zea mays
caaacgcttgatgtgacccgg

SEQ ID NO: 188 - DNA, 21 bp, Zea mays
aaggccttgttcgtttgtgcc

SEQ ID NO: 189 - DNA, 21 bp, Zea mays
ataactaaccttaggcagaaa

SEQ ID NO: 190 - DNA, 21 bp, Zea mays
cggccaaccaaccaatcacgt

SEQ ID NO: 191 - DNA, 21 bp, Zea mays
ttggcacagacctcattgcta

SEQ ID NO: 192 - DNA, 21 bp, Zea mays
ccagggcgccgccgtcggcga

SEQ ID NO: 193 - DNA, 21 bp, Zea mays
gcgtctgaacggatggcttcg

SEQ ID NO: 194 - DNA, 21 bp, Zea mays
gtgggccgtgcttttgtgggc

SEQ ID NO: 195 - DNA, 21 bp, Zea mays
taggatgtgtttggttgcggg

SEQ ID NO: 196 - DNA, 21 bp, Zea mays
ccatagcactcggcaaaagaa

SEQ ID NO: 197 - DNA, 21 bp, Zea mays
ataactaaccttaggcaaaaa

SEQ ID NO: 198 - DNA, 21 bp, Zea mays
gagactttgccgagtgtgccc

SEQ ID NO: 199 - DNA, 21 bp, Zea mays
gacacaaacgaacaaggcatc

SEQ ID NO: 200 - DNA, 21 bp, Zea mays
aaaacactcggcaaagaagct

SEQ ID NO: 201 - DNA, 21 bp, Zea mays
gcttctttgccgagtgttttc

SEQ ID NO: 202 - DNA, 21 bp, Zea mays
aaaagcactcggcaaagaagc

SEQ ID NO: 203 - DNA, 21 bp, Zea mays
gtagagatggcaatggggacc

SEQ ID NO: 204 - DNA, 21 bp, Zea mays
agttagccacgaaccaaacat

SEQ ID NO: 205 - DNA, 21 bp, Zea mays
gaaacgaacaaggcctaaacg

SEQ ID NO: 206 - DNA, 21 bp, Zea mays
aggccttgttcgtttctgccg

SEQ ID NO: 207 - DNA, 21 bp, Zea mays
gacgtgaacgagactccggat

SEQ ID NO: 208 - DNA, 21 bp, Zea mays
atgtccccgttgcaacgcatg

SEQ ID NO: 209 - DNA, 21 bp, Zea mays
ctgatttggtgacccgggatt

SEQ ID NO: 210 - DNA, 21 bp, Zea mays
agcccggcagcaaaccaggat

SEQ ID NO: 211 - DNA, 21 bp, Zea mays
gtggcaagttagacagtgaac

SEQ ID NO: 212 - DNA, 21 bp, Zea mays
ccccccccccccccccccaat

SEQ ID NO: 213 - DNA, 21 bp, Zea mays
tagggctagtttgggagtcat

SEQ ID NO: 214 - DNA, 21 bp, Zea mays
cgtgcgttgctacggagtcaa

SEQ ID NO: 215 - DNA, 21 bp, Zea mays
tggtgcaagcgtgcaaccaaa

SEQ ID NO: 216 - DNA, 21 bp, Zea mays
tagtccctagaaaccaaacaa

SEQ ID NO: 217 - DNA, 21 bp, Zea mays
gacacaaacgaacaaggccta

SEQ ID NO: 218 - DNA, 21 bp, Zea mays
aggccttgttcgtttgtgtcg

SEQ ID NO: 219 - DNA, 21 bp, Zea mays
cagactttcaacgtgtgttga

SEQ ID NO: 220 - DNA, 21 bp, Zea mays
cccgccttgcaccaagtgaat

SEQ ID NO: 221 - DNA, 21 bp, Zea mays
cgatctgcaccaagcgagccc

SEQ ID NO: 222 - DNA, 21 bp, Zea mays
ggcaaagtgtggcaagttaga

SEQ ID NO: 223 - DNA, 21 bp, Zea mays
caagatctatggcgccgagct

SEQ ID NO: 224 - DNA, 21 bp, Zea mays
tgaggccttgttcgtttgtgc

SEQ ID NO: 225 - DNA, 21 bp, Zea mays
agcctttgccgagtgtcaggc

SEQ ID NO: 226 - DNA, 21 bp, Zea mays
ggcgctgatgaccgtcgctga

SEQ ID NO: 227 - DNA, 21 bp, Zea mays
aagggtgcgtttggttgtaat

SEQ ID NO: 228 - DNA, 21 bp, Zea mays
aaactttggttgagaccaatc

SEQ ID NO: 229 - DNA, 21 bp, Zea mays
tagggctagtttgggagcaaa

SEQ ID NO: 230 - DNA, 21 bp, Zea mays
acagcctaaggttaggcatgc

SEQ ID NO: 231 - DNA, 21 bp, Zea mays
gtttggtttgtggctaattat

SEQ ID NO: 232 - DNA, 21 bp, Zea mays
agccaaggatgagctgcctgt

SEQ ID NO: 233 - DNA, 21 bp, Zea mays
aggcagtctccttggctagtc

SEQ ID NO: 234 - DNA, 21 bp, Zea mays
cttgtgacttgcgacgatgcg

SEQ ID NO: 235 - DNA, 21 bp, Zea mays
cctactttttcatctcccgca

SEQ ID NO: 236 - DNA, 21 bp, Zea mays
agccacgaaccaaacaagccc

SEQ ID NO: 237 - DNA, 21 bp, Zea mays
gctgatttggtgaccagagaa

SEQ ID NO: 238 - DNA, 21 bp, Zea mays
gaagctcctttcagctgatgc

SEQ ID NO: 239 - DNA, 21 bp, Zea mays
taggatgtgtttggttgcctg

SEQ ID NO: 240 - DNA, 21 bp, Zea mays
ggattgaccctacctgcaggt

SEQ ID NO: 241 - DNA, 21 bp, Zea mays
gtgatgagggtacggctccag

SEQ ID NO: 242 - DNA, 21 bp, Zea mays
acaagtaaggccgcaacggta

SEQ ID NO: 243 - DNA, 21 bp, Zea mays
gagtccaaataccggagagga

SEQ ID NO: 244 - DNA, 21 bp, Zea mays
aggtgagtgaccgtgcgtcat

SEQ ID NO: 245 - DNA, 21 bp, Zea mays
cacgccaaagcacaggtctaa

SEQ ID NO: 246 - DNA, 21 bp, Zea mays
ctgatttggtgacccgggatc

SEQ ID NO: 247 - DNA, 21 bp, Zea mays
tcgtctaacctcaatctcatt

SEQ ID NO: 248 - DNA, 21 bp, Zea mays
ggcaaagtgtggcaagttagg

SEQ ID NO: 249 - DNA, 21 bp, Zea mays
ccagactagtcggttgtccgt

SEQ ID NO: 250 - DNA, 21 bp, Zea mays
gagaagacgacggagtcgctc

SEQ ID NO: 251 - DNA, 21 bp, Zea mays
tcgcgagctaaacgagccgag

SEQ ID NO: 252 - DNA, 21 bp, Zea mays
gtgccacagacgcggtctagg

SEQ ID NO: 253 - DNA, 21 bp, Zea mays
actctaaatttagaggatgag

SEQ ID NO: 254 - DNA, 21 bp, Zea mays
gaagcctggtccgagatcttg

SEQ ID NO: 255 - DNA, 21 bp, Zea mays
tagggctagtttgggagttag

SEQ ID NO: 256 - DNA, 21 bp, Zea mays
gagatgctagggctatccacg

SEQ ID NO: 257 - DNA, 21 bp, Zea mays
aatttcggatacggatacggg

SEQ ID NO: 258 - DNA, 21 bp, Zea mays
gaatggacggctgagatcgca

SEQ ID NO: 259 - DNA, 21 bp, Zea mays
aggccttgttcgtttgtgccg

SEQ ID NO: 260 - DNA, 21 bp, Zea mays
acttgctagaggccaactgga

SEQ ID NO: 261 - DNA, 21 bp, Zea mays
gctgtttggactgctgctaga

SEQ ID NO: 262 - DNA, 21 bp, Zea mays
gtgacaagttaggcagggaac

SEQ ID NO: 263 - DNA, 21 bp, Zea mays
aggccttgttcgtttctgtcg

SEQ ID NO: 264 - DNA, 21 bp, Zea mays
tgcgtttggttgcaatgatag

SEQ ID NO: 265 - DNA, 21 bp, Zea mays
acggctatcgggtcccattga

SEQ ID NO: 266 - DNA, 21 bp, Zea mays
aagtcaaacgcttgatgtgac

SEQ ID NO: 267 - DNA, 21 bp, Zea mays
gctgtttttttttcttttaga

SEQ ID NO: 268 - DNA, 21 bp, Zea mays
tcgcgttctttgccgagtgtc

SEQ ID NO: 269 - DNA, 21 bp, Zea mays
ctcagttgccacagtttgcca

SEQ ID NO: 270 - DNA, 21 bp, Zea mays
tcactctcttctgtcagccac

SEQ ID NO: 271 - DNA, 21 bp, Zea mays
taagcttatgtccgacggtgg

SEQ ID NO: 272 - DNA, 21 bp, Zea mays
taagcttatgtccgactgctt

SEQ ID NO: 273 - DNA, 21 bp, Zea mays
gctgatttggtgaccagggat

SEQ ID NO: 274 - DNA, 21 bp, Zea mays
ataggctatgacgccgagtta

SEQ ID NO: 275 - DNA, 21 bp, Zea mays
aagacaaagggcctgtttggt

SEQ ID NO: 276 - DNA, 21 bp, Zea mays
cttgcaggtagaagccatctt

SEQ ID NO: 277 - DNA, 21 bp, Zea mays
tagggctagtttgggaggtcc

SEQ ID NO: 278 - DNA, 21 bp, Zea mays
gtgcgagattcgctggcgtgg

SEQ ID NO: 279 - DNA, 21 bp, Zea mays
ctcagcagaggaggcagcacg

SEQ ID NO: 280 - DNA, 21 bp, Zea mays
cacgcacgcagggtcaccggc

SEQ ID NO: 281 - DNA, 21 bp, Zea mays
aaggccttgttcgtttgtgtt

SEQ ID NO: 282 - DNA, 21 bp, Zea mays
taggctatctccagcaatcta

SEQ ID NO: 283 - DNA, 21 bp, Zea mays
ccagactgtttgcagcctctc

SEQ ID NO: 284 - DNA, 21 bp, Zea mays
gtgagaggctgcaaacagtct

SEQ ID NO: 285 - DNA, 21 bp, Zea mays
gaggggctgcaaacagcctgc

SEQ ID NO: 286 - DNA, 21 bp, Zea mays
aatcgtcgactagggcgacta

SEQ ID NO: 287 - DNA, 21 bp, Zea mays
tagggctagtttgggagcaag

SEQ ID NO: 288 - DNA, 21 bp, Zea mays
aggaccgaccaggcgcctaat

SEQ ID NO: 289 - DNA, 21 bp, Zea mays
cactcggcaaagaacactcgg

SEQ ID NO: 290 - DNA, 21 bp, Zea mays
atgacgaccgttgaaactggt

SEQ ID NO: 291 - DNA, 21 bp, Zea mays
ggcaaagtgtggcaagttaag

SEQ ID NO: 292 - DNA, 21 bp, Zea mays
agttagccacgaaccaaacaa

SEQ ID NO: 293 - DNA, 21 bp, Zea mays
ccgacgcaaacgaacaaagcc

SEQ ID NO: 294 - DNA, 21 bp, Zea mays
cccgtgcgttgcaacgggaat

SEQ ID NO: 295 - DNA, 21 bp, Zea mays
actgttggactgcgggtttcc

SEQ ID NO: 296 - DNA, 21 bp, Zea mays
gagtccaaataccggagggga

SEQ ID NO: 297 - DNA, 21 bp, Zea mays
ctgtgagtgcgacgacgacgg

SEQ ID NO: 298 - DNA, 21 bp, Zea mays
gtgagccgtcgcaacgcacag

SEQ ID NO: 299 - DNA, 21 bp, Zea mays
cgttgcgacggctcacaacaa

SEQ ID NO: 300 - DNA, 21 bp, Zea mays
gcttctttgccgagtgttttt

SEQ ID NO: 301 - DNA, 21 bp, Zea mays
aggcagtctccttggctagcc

SEQ ID NO: 302 - DNA, 21 bp, Zea mays
tgaggccttgttcgtttatgt

SEQ ID NO: 303 - DNA, 21 bp, Zea mays
actccactttgccgagtgcaa

SEQ ID NO: 304 - DNA, 21 bp, Zea mays
gcttctttgccgagtgtcagg

SEQ ID NO: 305 - DNA, 21 bp, Zea mays
taggcgagtcgtgactgcgtc

SEQ ID NO: 306 - DNA, 21 bp, Zea mays
ctgggccagacccattacaga

SEQ ID NO: 307 - DNA, 21 bp, Zea mays
ccaaacaatgtagtggacggt

SEQ ID NO: 308 - DNA, 21 bp, Zea mays
gttaggaacgtgggtacccac

SEQ ID NO: 309 - DNA, 21 bp, Zea mays
tagtccctagaaaccaaatac

SEQ ID NO: 310 - DNA, 21 bp, Zea mays
gtttggtttgtggctaattac

SEQ ID NO: 311 - DNA, 21 bp, Zea mays
atgtgcccgtgcgttgcgacg

SEQ ID NO: 312 - DNA, 21 bp, Zea mays
aggccttgttcgtttgtaccg

SEQ ID NO: 313 - DNA, 21 bp, Zea mays
tagggctagtttgggagcaca

SEQ ID NO: 314 - DNA, 21 bp, Zea mays
ccttttctcggcgtcatagtc

SEQ ID NO: 315 - DNA, 21 bp, Zea mays
cactcggcaaagaaggcacac

SEQ ID NO: 316 - DNA, 21 bp, Zea mays
tagggctagtttgggagccat

SEQ ID NO: 317 - DNA, 21 bp, Zea mays
agcaatccggttaggaatcgt

SEQ ID NO: 318 - DNA, 21 bp, Zea mays
gcctctgctaagccgtcagac

SEQ ID NO: 319 - DNA, 21 bp, Zea mays
actagcaggctgacgggctat

SEQ ID NO: 320 - DNA, 21 bp, Zea mays
gagacactggatatagggttg

SEQ ID NO: 321 - DNA, 21 bp, Zea mays
aaaggcactcggcaaaggctc

SEQ ID NO: 322 - DNA, 21 bp, Zea mays
cacaaacgaacaagaccttag

SEQ ID NO: 323 - DNA, 21 bp, Zea mays
gtttggtttgtggctaactgt

SEQ ID NO: 324 - DNA, 21 bp, Zea mays
cactcgacaaagaaggcacac

SEQ ID NO: 325 - DNA, 21 bp, Zea mays
gagagccacaaaaccggaggg

SEQ ID NO: 326 - DNA, 21 bp, Zea mays
taagtgccggtgggctcagcc

SEQ ID NO: 327 - DNA, 21 bp, Zea mays
aggccttgttcgtttgcgtcg

SEQ ID NO: 328 - DNA, 21 bp, Zea mays
cccaaatagggccttagatca

SEQ ID NO: 329 - DNA, 21 bp, Zea mays
aaggccttgttcgtttgtgtc

SEQ ID NO: 330 - DNA, 21 bp, Zea mays
gacacaaacgaacaaggcctt

SEQ ID NO: 331 - DNA, 21 bp, Zea mays
cgtgggtacccacgttcttac

SEQ ID NO: 332 - DNA, 21 bp, Zea mays
aaccgaacaaggcctaaggtg

SEQ ID NO: 333 - DNA, 21 bp, Zea mays
gcgtgctggagcaacggcgat

SEQ ID NO: 334 - DNA, 21 bp, Zea mays
tgtgccagaccggcccatatg

SEQ ID NO: 335 - DNA, 21 bp, Zea mays
agagctgatttggtgattggg

SEQ ID NO: 336 - DNA, 21 bp, Zea mays
cccaagaatcaggtgaagacg

SEQ ID NO: 337 - DNA, 21 bp, Zea mays
agccacgaaccaaacaacccg

SEQ ID NO: 338 - DNA, 21 bp, Zea mays
aaaccaggccgtttgcagccc

SEQ ID NO: 339 - DNA, 21 bp, Zea mays
accttaggcaaagtgtgacac

SEQ ID NO: 340 - DNA, 21 bp, Zea mays
cccgtgcgttgcaacggggac

SEQ ID NO: 341 - DNA, 21 bp, Zea mays
tttctcacggtccatctgtga

SEQ ID NO: 342 - DNA, 21 bp, Zea mays
agttagccacgaaccaaatag

SEQ ID NO: 343 - DNA, 21 bp, Zea mays
gtttggtttgtggctaactat

SEQ ID NO: 344 - DNA, 21 bp, Zea mays
tcgacgacactgtcaacggcg

SEQ ID NO: 345 - DNA, 21 bp, Zea mays
agggcttgttcggttgcgaga

SEQ ID NO: 346 - DNA, 21 bp, Zea mays
gacacaaacgaacaaggtctt

SEQ ID NO: 347 - DNA, 21 bp, Zea mays
aaggccttgttcgtttgtgct

SEQ ID NO: 348 - DNA, 21 bp, Zea mays
tgctcgtgcgttgcaacggaa

SEQ ID NO: 349 - DNA, 21 bp, Zea mays
tagtccctagaaaccaaaccc

SEQ ID NO: 350 - DNA, 21 bp, Zea mays
agagctgatttggtgatcaga

SEQ ID NO: 351 - DNA, 21 bp, Zea mays
tagggctagtttgggagcctc

SEQ ID NO: 352 - DNA, 21 bp, Zea mays
agggtaggatacaggatgaca

SEQ ID NO: 353 - DNA, 21 bp, Zea mays
aaaacactcggcaaagagctt

SEQ ID NO: 354 - DNA, 21 bp, Zea mays
atcggatgcaccagatcgttt

SEQ ID NO: 355 - DNA, 21 bp, Zea mays
caaccatatcggtcggctttg

SEQ ID NO: 356 - DNA, 21 bp, Zea mays
gacgacaaccagcgagcccta

SEQ ID NO: 357 - DNA, 21 bp, Zea mays
tagtccctagaaaccaagcac

SEQ ID NO: 358 - DNA, 21 bp, Zea mays
cgaccgaccgaccgacctgct

SEQ ID NO: 359 - DNA, 21 bp, Zea mays
aaccgaccggtttgaccgccg

SEQ ID NO: 360 - DNA, 21 bp, Zea mays
caacttgaccatgggagccag

SEQ ID NO: 361 - DNA, 21 bp, Zea mays
cggcttgctgcggctgcaatc

SEQ ID NO: 362 - DNA, 21 bp, Zea mays
agaacagagcggctccgttct

SEQ ID NO: 363 - DNA, 21 bp, Zea mays
cggcacaaacgaacaaagcct

SEQ ID NO: 364 - DNA, 21 bp, Zea mays
cggcaagttgttcttggctac

SEQ ID NO: 365 - DNA, 21 bp, Zea mays
ccaattcgtcgaagccggact

SEQ ID NO: 366 - DNA, 21 bp, Zea mays
accgtttggtcatctatattt

SEQ ID NO: 367 - DNA, 21 bp, Zea mays
ttgttcggttagctctcaact

SEQ ID NO: 368 - DNA, 21 bp, Zea mays
caagcccgaaaaggcccatat

SEQ ID NO: 369 - DNA, 21 bp, Zea mays
ggcctattagctcagttggtt

SEQ ID NO: 370 - DNA, 21 bp, Zea mays
gacccggactaaactttagca

SEQ ID NO: 371 - DNA, 21 bp, Zea mays
gcttctttgccgagtgttgtg

SEQ ID NO: 372 - DNA, 21 bp, Zea mays
agttgctttggcagtgtgcgg

SEQ ID NO: 373 - DNA, 21 bp, Zea mays
gcttctttgccgagtgtctaa

SEQ ID NO: 374 - DNA, 21 bp, Zea mays
ttctttgccgagtgccaaggc

SEQ ID NO: 375 - DNA, 21 bp, Zea mays
caagcgctcgacaaattgtct

SEQ ID NO: 376 - DNA, 21 bp, Zea mays
agttagccacgaaccaaacgt

SEQ ID NO: 377 - DNA, 21 bp, Zea mays
aaaaagcactcgacaaagcgc

SEQ ID NO: 378 - DNA, 21 bp, Zea mays
atcttagtctctaaattgcta

SEQ ID NO: 379 - DNA, 21 bp, Zea mays
cgtgcgagcaagccgtaggat

SEQ ID NO: 380 - DNA, 21 bp, Zea mays
cagacactcggcaaagtttat

SEQ ID NO: 381 - DNA, 21 bp, Zea mays
aagagccggattccggtagtg

SEQ ID NO: 382 - DNA, 21 bp, Zea mays
atcccacgggcctggctgagg

SEQ ID NO: 383 - DNA, 21 bp, Zea mays
acatgattaaggtcttgcgga

SEQ ID NO: 384 - DNA, 21 bp, Zea mays
gaagggcacagctgagcaaaa

SEQ ID NO: 385 - DNA, 21 bp, Zea mays
gaataagggctaaaccgacgg

SEQ ID NO: 386 - DNA, 21 bp, Zea mays
cggtttagcccttattcccgt

SEQ ID NO: 387 - DNA, 21 bp, Zea mays
tgcgctaagcacgtttgattc

SEQ ID NO: 388 - DNA, 21 bp, Zea mays
tgggaatcagacctgatctgc

SEQ ID NO: 389 - DNA, 21 bp, Zea mays
aactttggtgacaggaacaaa

SEQ ID NO: 390 - DNA, 21 bp, Zea mays
gccgcctaggtctccgacgtg

SEQ ID NO: 391 - DNA, 21 bp, Zea mays
cgccgcggcgccgcctcggcg

SEQ ID NO: 392 - DNA, 21 bp, Zea mays
cgtgggtacccacgttcttaa

SEQ ID NO: 393 - DNA, 21 bp, Zea mays
tcgacctctgctgagcgcgct

SEQ ID NO: 394 - DNA, 21 bp, Zea mays
aggatgaagccgctctgttcc

SEQ ID NO: 395 - DNA, 21 bp, Zea mays
cagtgttgtccccagttgtcc

SEQ ID NO: 396 - DNA, 21 bp, Zea mays
gatgcattttgcgcatggaag

SEQ ID NO: 397 - DNA, 21 bp, Zea mays
gatgcattttgcgcatggagc

SEQ ID NO: 398 - DNA, 21 bp, Zea mays
agagcatctccaacaatgcct

SEQ ID NO: 399 - DNA, 21 bp, Zea mays
  unsure (21): n = A, C, G or T
tagtccctagaaaccaaacan

SEQ ID NO: 400 - DNA, 21 bp, Zea mays
gacacaaacgaacaagggcta

SEQ ID NO: 401 - DNA, 21 bp, Zea mays
gtgtacgactcgtctggcaag

SEQ ID NO: 402 - DNA, 21 bp, Zea mays
ttggcacggctcaatcagaaa

SEQ ID NO: 403 - DNA, 21 bp, Zea mays
tagtccctagaaaccaaacag

SEQ ID NO: 404 - DNA, 21 bp, Zea mays
agatcatgttgcagcttcact

SEQ ID NO: 405 - DNA, 21 bp, Zea mays
gacccggactaaactttagtc

SEQ ID NO: 406 - DNA, 21 bp, Zea mays
gtgctttttagtgtcgtgccc

SEQ ID NO: 407 - DNA, 21 bp, Zea mays
aggacttccgagtagcacctc

SEQ ID NO: 408 - DNA, 21 bp, Zea mays
gaaacgaacaaggcctaagct

SEQ ID NO: 409 - DNA, 21 bp, Zea mays
aggccttgttcgtttctatcg

SEQ ID NO: 410 - DNA, 21 bp, Zea mays
  unsure (19)..(20)..(21): n = A, C, G or T
agggcttgttcggttgcannn

SEQ ID NO: 411 - DNA, 21 bp, Zea mays
agactgtgtccaacaagcacc

SEQ ID NO: 412 - DNA, 21 bp, Zea mays
gtgagttgtgactgcgtgtcc

SEQ ID NO: 413 - DNA, 21 bp, Zea mays
ggatcggaccaaaacacgcgg

SEQ ID NO: 414 - DNA, 21 bp, Zea mays
cgtgggtacccacgttcttta

SEQ ID NO: 415 - DNA, 21 bp, Zea mays
gagggtgacttggccagccat

SEQ ID NO: 416 - DNA, 21 bp, Zea mays
gtggcaagagaattgaagaaa

SEQ ID NO: 417 - DNA, 21 bp, Zea mays
catcaaaactgagggcaccaa

SEQ ID NO: 418 - DNA, 21 bp, Zea mays
tcgtgcttcgtgccaaatgga

SEQ ID NO: 419 - DNA, 21 bp, Zea mays
agggctggacaaaatgctcgt

SEQ ID NO: 420 - DNA, 21 bp, Zea mays
gccataggctatggcgccgag

SEQ ID NO: 421 - DNA, 21 bp, Zea mays
catagcctatggcgccgagca

SEQ ID NO: 422 - DNA, 21 bp, Zea mays
cccgtgcgttgcgacggttca

SEQ ID NO: 423 - DNA, 21 bp, Zea mays
tagggctagtttgggagacac

SEQ ID NO: 424 - DNA, 21 bp, Zea mays
ccgagctcggcgccatagatt

SEQ ID NO: 425 - DNA, 21 bp, Zea mays
catagcctatggcgccgaggt

SEQ ID NO: 426 - DNA, 21 bp, Zea mays
tgcttatgggaagggagacag

SEQ ID NO: 427 - DNA, 21 bp, Zea mays
gtcttagggtccgcttgtgaa

SEQ ID NO: 428 - DNA, 21 bp, Zea mays
tgtgccagaccggcccacata

SEQ ID NO: 429 - DNA, 21 bp, Zea mays
gcacgacgaccgttgaaactg

SEQ ID NO: 430 - DNA, 21 bp, Zea mays
aaacgaacaaggcctaaagag

SEQ ID NO: 431 - DNA, 21 bp, Zea mays
aagaactaaccttaggcagaa

SEQ ID NO: 432 - DNA, 21 bp, Zea mays
cgcattggacttgcacgtgtg

SEQ ID NO: 433 - DNA, 21 bp, Zea mays
acagcctatggcgccgagtat

SEQ ID NO: 434 - DNA, 21 bp, Zea mays
cccccccccccccccccaatt

SEQ ID NO: 435 - DNA, 21 bp, Zea mays
cccgtgcgttgcaacgggaac

SEQ ID NO: 436 - DNA, 21 bp, Zea mays
gaagtggagtggagcgggcgc

SEQ ID NO: 437 - DNA, 21 bp, Zea mays
tggcagaaccggaatggtggc

SEQ ID NO: 438 - DNA, 21 bp, Zea mays
tagtccctagaaaccaatcac

SEQ ID NO: 439 - DNA, 21 bp, Zea mays
acggcccagcccgcgattcgt

SEQ ID NO: 440 - DNA, 21 bp, Zea mays
ctgtgccaaacagggcctaag

SEQ ID NO: 441 - DNA, 21 bp, Zea mays
ggtgacagagcctttgtcgag

SEQ ID NO: 442 - DNA, 21 bp, Zea mays
cacaaacgaacaagacctaaa

SEQ ID NO: 443 - DNA, 21 bp, Zea mays
gcagcaagactgacttcgcgg

SEQ ID NO: 444 - DNA, 21 bp, Zea mays
tagggctagtttgggagctac

SEQ ID NO: 445 - DNA, 21 bp, Zea mays
cctgagccaggctcaccagat

SEQ ID NO: 446 - DNA, 21 bp, Zea mays
ggactaagtattggctcggcg

SEQ ID NO: 447 - DNA, 21 bp, Zea mays
gcgagaggtcccgagttcaat

SEQ ID NO: 448 - DNA, 21 bp, Zea mays
ttggcacggctcaatcaatta

SEQ ID NO: 449 - DNA, 21 bp, Zea mays
gatgagctagcgcctgcgatt

SEQ ID NO: 450 - DNA, 21 bp, Zea mays
gtttggtttgtggctaaatgt

SEQ ID NO: 451 - DNA, 21 bp, Zea mays
gggcctgtttggtttgtagct

SEQ ID NO: 452 - DNA, 21 bp, Zea mays
cagtgttgtccccagttatcc

SEQ ID NO: 453 - DNA, 21 bp, Zea mays
atgtgttaaggtggattagga

SEQ ID NO: 454 - DNA, 21 bp, Zea mays
gaaaccgaacagggccttagt

SEQ ID NO: 455 - DNA, 21 bp, Zea mays
cactcggcaaagaacacttga

SEQ ID NO: 456 - DNA, 21 bp, Zea mays
tggcgcctgagaatccatagt

SEQ ID NO: 457 - DNA, 21 bp, Zea mays
aagggtgcgtttggttgcggg

SEQ ID NO: 458 - DNA, 21 bp, Zea mays
agagcaggctcggatgagcga

SEQ ID NO: 459 - DNA, 21 bp, Zea mays
gacacgctagatctgggggga

SEQ ID NO: 460 - DNA, 21 bp, Zea mays
gcacgtgattcacagggacat

SEQ ID NO: 461 - DNA, 21 bp, Zea mays
gatcgaaaaggccgtcccttt

SEQ ID NO: 462 - DNA, 21 bp, Zea mays
aacaaaactgggacagaacgg

SEQ ID NO: 463 - DNA, 21 bp, Zea mays
ttagctggaacgattccgggt

SEQ ID NO: 464 - DNA, 21 bp, Zea mays
ttctttgccgagtgccataac

SEQ ID NO: 465 - DNA, 21 bp, Zea mays
cgggcggcgggttcgcgtcgg

SEQ ID NO: 466 - DNA, 21 bp, Zea mays
tggcactcggcaaagaaccaa

SEQ ID NO: 467 - DNA, 21 bp, Zea mays
taaaaagaaatggagggagta

SEQ ID NO: 468 - DNA, 21 bp, Zea mays
gccatagcctatgacgccgag

SEQ ID NO: 469 - DNA, 21 bp, Zea mays
ggcccgtttggccatctatac

SEQ ID NO: 470 - DNA, 21 bp, Zea mays
cgtttgcgtcgcgctctatat

SEQ ID NO: 471 - DNA, 21 bp, Zea mays
gaaaccgaacagggcctaaag

SEQ ID NO: 472 - DNA, 21 bp, Zea mays
ttagctggaacgattcctggt

SEQ ID NO: 473 - DNA, 21 bp, Zea mays
cccgtgcgttgcaacggaaac

SEQ ID NO: 474 - DNA, 21 bp, Zea mays
aaaaagcactcgacaaaaaaa

SEQ ID NO: 475 - DNA, 21 bp, Zea mays
gggcctgtttggtttgtgtct

SEQ ID NO: 476 - DNA, 21 bp, Zea mays
ctaaacactatgctgtgggtc

SEQ ID NO: 477 - DNA, 21 bp, Zea mays
cactgtgcgccatcatcaaat

SEQ ID NO: 478 - DNA, 21 bp, Zea mays
cccgttcttgctacctgctaa

SEQ ID NO: 479 - DNA, 21 bp, Zea mays
atgtgcccgtgcgttgccacg

SEQ ID NO: 480 - DNA, 21 bp, Zea mays
ggacttggaggtgctactcga

SEQ ID NO: 481 - DNA, 21 bp, Zea mays
aaggctgtaaggggtaggctg

SEQ ID NO: 482 - DNA, 21 bp, Zea mays
cacagagtggtggagcgtgca

SEQ ID NO: 483 - DNA, 21 bp, Zea mays
gtcagtagcgacttacgtggc

SEQ ID NO: 484 - DNA, 21 bp, Zea mays
gaaaccgaacagggccttagg

SEQ ID NO: 485 - DNA, 21 bp, Zea mays
cggcaagttgtccttggctac

SEQ ID NO: 486 - DNA, 21 bp, Zea mays
ttgtgcgtccattggtgaccg

SEQ ID NO: 487 - DNA, 21 bp, Zea mays
acagcctatggcgccgagcaa

SEQ ID NO: 488 - DNA, 21 bp, Zea mays
tcaccagcgacgaggagcacc

SEQ ID NO: 489 - DNA, 21 bp, Zea mays
gtttggtttgtggctaatatg

SEQ ID NO: 490 - DNA, 21 bp, Zea mays
gccacactttgtctaagttta

SEQ ID NO: 491 - DNA, 21 bp, Zea mays
ctaaacactgtgctgtgggtc

SEQ ID NO: 492 - DNA, 21 bp, Zea mays
actggcaggtgatgtgccgcc

SEQ ID NO: 493 - DNA, 21 bp, Zea mays
aagcggaccctaagacaaaac

SEQ ID NO: 494 - DNA, 21 bp, Zea mays
tctgcattgccgaggctggtg

SEQ ID NO: 495 - DNA, 21 bp, Zea mays
tcccgtcagcagtagaggcgt

SEQ ID NO: 496 - DNA, 21 bp, Zea mays
tggatcagatggtttgctgac

SEQ ID NO: 497 - DNA, 21 bp, Zea mays
cacatttctctacggtgcacg

SEQ ID NO: 498 - DNA, 21 bp, Zea mays
gagagccacaaaaccggaagg

SEQ ID NO: 499 - DNA, 21 bp, Zea mays
cagggatgagacagagcatgg

SEQ ID NO: 500 - DNA, 21 bp, Zea mays
acagccgtcggacataagtta

SEQ ID NO: 501 - DNA, 21 bp, Zea mays
ccttgtgcaggcaaccaaaca

SEQ ID NO: 502 - DNA, 21 bp, Zea mays
aacatgatgccgcgggaaaca

SEQ ID NO: 503 - DNA, 21 bp, Zea mays
cttgggccgggccggcccggc

SEQ ID NO: 504 - DNA, 21 bp, Zea mays
aggccttgttcgtttgtgtta

SEQ ID NO: 505 - DNA, 21 bp, Zea mays
aaaacactcggcaaagaatct

SEQ ID NO: 506 - DNA, 21 bp, Zea mays
acggcggcgccggcggcgtca

SEQ ID NO: 507 - DNA, 21 bp, Zea mays
gttggctagagggtggaaggc

SEQ ID NO: 508 - DNA, 21 bp, Zea mays
tgcgtttggttgcaatgacat

SEQ ID NO: 509 - DNA, 21 bp, Zea mays
ggctgcaggagctgtgccaga

SEQ ID NO: 510 - DNA, 21 bp, Zea mays
agagcatctccaacaatgtgc

SEQ ID NO: 511 - DNA, 21 bp, Zea mays
tagtccctagaaaccaaacga

SEQ ID NO: 512 - DNA, 21 bp, Zea mays
cagacactcggcaaagtatat

SEQ ID NO: 513 - DNA, 21 bp, Zea mays
atgatgtgtttggttcggtgt

SEQ ID NO: 514 - DNA, 21 bp, Zea mays
cccgtgcgttgcgacggaacc

SEQ ID NO: 515 - DNA, 21 bp, Zea mays
gtgagtgtccgtgcgttgcaa

SEQ ID NO: 516 - DNA, 21 bp, Zea mays
catagcctatggcgccgagat

SEQ ID NO: 517 - DNA, 21 bp, Zea mays
  unsure (20)..(21): n = A, C, G or T
gccataggctatggcgccgnn

SEQ ID NO: 518 - DNA, 21 bp, Zea mays
  unsure (21): n = A, C, G or T
ccgcgggggtcgcctgaggtn

SEQ ID NO: 519 - DNA, 21 bp, Zea mays
agaacgtgaccagttaaacgg

SEQ ID NO: 520 - DNA, 21 bp, Zea mays
gtcaaagtaggatgagtcggg

SEQ ID NO: 521 - DNA, 21 bp, Zea mays
tcaccagcgctgcactcaatt

SEQ ID NO: 522 - DNA, 21 bp, Zea mays
tacactatagtgcctaatcgt

SEQ ID NO: 523 - DNA, 21 bp, Zea mays
agttttgtctcgcgggtatgg

SEQ ID NO: 524 - DNA, 21 bp, Zea mays
cgtgctttgaccgggtgggaa

SEQ ID NO: 525 - DNA, 21 bp, Zea mays
cactcggcaaagagccaaatt

SEQ ID NO: 526 - DNA, 21 bp, Zea mays
gatcaggttgcgttggtaatc

SEQ ID NO: 527 - DNA, 21 bp, Zea mays
aatccacatggattgagatga

SEQ ID NO: 528 - DNA, 21 bp, Zea mays
agagctgcaagcctgcaaaag

SEQ ID NO: 529 - DNA, 21 bp, Zea mays
aaaacactcggcaaagaattt

SEQ ID NO: 530 - DNA, 21 bp, Zea mays
aaggcctgtaggacttcgctc

SEQ ID NO: 531 - DNA, 21 bp, Zea mays
taggatgtgtttggttgcaat

SEQ ID NO: 532 - DNA, 21 bp, Zea mays
taggcagattgtggcgcttta

SEQ ID NO: 533 - DNA, 21 bp, Zea mays
gaactgcgcagatcgacgacg

SEQ ID NO: 534 - DNA, 21 bp, Zea mays
gctaacttcctagaggctaca

SEQ ID NO: 535 - DNA, 21 bp, Zea mays
ggtgacctggcgcgcacggta

SEQ ID NO: 536 - DNA, 21 bp, Zea mays
tagggctagtttgggagttca

SEQ ID NO: 537 - DNA, 21 bp, Zea mays
ggtgctagcacggcacaatct

SEQ ID NO: 538 - DNA, 21 bp, Zea mays
gtggcaaacagtttgtcggct

SEQ ID NO: 539 - DNA, 21 bp, Zea mays
taggcagattgtggcgcctta

SEQ ID NO: 540 - DNA, 21 bp, Zea mays
gtatcgcacgagacaggctag

SEQ ID NO: 541 - DNA, 21 bp, Zea mays
ctttgccgagtgttttttttt

SEQ ID NO: 542 - DNA, 21 bp, Zea mays
gttttggaccctttgctcggc

SEQ ID NO: 543 - DNA, 21 bp, Zea mays
cacgagtcgagcgagcttaca

SEQ ID NO: 544 - DNA, 21 bp, Zea mays
ccgggtgcaatccgacgtaaa

SEQ ID NO: 545 - DNA, 21 bp, Zea mays
cctatggcgccgagcaaaggg

SEQ ID NO: 546 - DNA, 21 bp, Zea mays
ttttacatcacaggcggttcg

SEQ ID NO: 547 - DNA, 21 bp, Zea mays
ccgtgcgttgcgacggtacac

SEQ ID NO: 548 - DNA, 21 bp, Zea mays
aagcctttgccgagtgtcgca

SEQ ID NO: 549 - DNA, 21 bp, Zea mays
tcgaggacgagctgcttgtct

SEQ ID NO: 550 - DNA, 21 bp, Zea mays
gccacactttgcctaagttta

SEQ ID NO: 551 - DNA, 21 bp, Zea mays
cgtgggtacccacgttcctaa

SEQ ID NO: 552 - DNA, 21 bp, Zea mays
gacacaaacgaacaaggtcta

SEQ ID NO: 553 - DNA, 21 bp, Zea mays
ggtagcgggtgcgtgtacgag

SEQ ID NO: 554 - DNA, 21 bp, Zea mays
tcgcgagctaaacgagctacc

SEQ ID NO: 555 - DNA, 21 bp, Zea mays
gctgtgggcgtgcaaatttag

SEQ ID NO: 556 - DNA, 21 bp, Zea mays
gacacaaacgaacaaggctta

SEQ ID NO: 557 - DNA, 21 bp, Zea mays
gactggcgggacacgtgtcca

SEQ ID NO: 558 - DNA, 21 bp, Zea mays
gaaaaaatctcttgcacctaa

SEQ ID NO: 559 - DNA, 21 bp, Zea mays
cactcggcaaagcccccttta

SEQ ID NO: 560 - DNA, 21 bp, Zea mays
agcggctcgtttgaccgtctg

SEQ ID NO: 561 - DNA, 21 bp, Zea mays
aggcaaagtgtgataagttag

SEQ ID NO: 562 - DNA, 21 bp, Zea mays
gaaaccgaacagggccttata

SEQ ID NO: 563 - DNA, 21 bp, Zea mays
atgtgcccgtgcgttgcttag

SEQ ID NO: 564 - DNA, 21 bp, Zea mays
aagtctgcttgcacgcttgca

SEQ ID NO: 565 - DNA, 21 bp, Zea mays
ttagctggaacgattccggtg

SEQ ID NO: 566 - DNA, 21 bp, Zea mays
actagccaggatttggtgggc

SEQ ID NO: 567 - DNA, 21 bp, Zea mays
gccaagatctatggcgccgac

SEQ ID NO: 568 - DNA, 21 bp, Zea mays
ccatagatcttggcgccgacc

SEQ ID NO: 569 - DNA, 21 bp, Zea mays
ctgtgccaaacagggccatta

SEQ ID NO: 570 - DNA, 21 bp, Zea mays
aaacgaacaaggcctaaggtt

SEQ ID NO: 571 - DNA, 21 bp, Zea mays
gcaggacgaccattgaaactg

SEQ ID NO: 572 - DNA, 21 bp, Zea mays
ccagactgtttgcagcccctc

SEQ ID NO: 573 - DNA, 21 bp, Zea mays
caagtgctcggtcgaagactt

SEQ ID NO: 574 - DNA, 21 bp, Zea mays
aactgacaggccgcagtgatg

SEQ ID NO: 575 - DNA, 21 bp, Zea mays
atcaggggcggacctacgtta

SEQ ID NO: 576 - DNA, 21 bp, Zea mays
acagttagcaggccggcatga

SEQ ID NO: 577 - DNA, 21 bp, Zea mays
tagtccctagaaaccaaacgc

SEQ ID NO: 578 - DNA, 21 bp, Zea mays
cccgtgcgttgcaacggcaaa

SEQ ID NO: 579 - DNA, 21 bp, Zea mays
taggatgtgtttggttgtaat

SEQ ID NO: 580 - DNA, 21 bp, Zea mays
agaacggagcgtcaacgtcca

SEQ ID NO: 581 - DNA, 21 bp, Zea mays
agagcatctccaacaatatct

SEQ ID NO: 582 - DNA, 21 bp, Zea mays
atcccactcacgtgtcacgtc

SEQ ID NO: 583 - DNA, 21 bp, Zea mays
accgtacttgtgccagcacgt

SEQ ID NO: 584 - DNA, 21 bp, Zea mays
gaggcgtaggcgagggattag

SEQ ID NO: 585 - DNA, 21 bp, Zea mays
gctgatttggtgaccaggaat

SEQ ID NO: 586 - DNA, 21 bp, Zea mays
gtgtgcacgcctacactacgt

SEQ ID NO: 587 - DNA, 21 bp, Zea mays
ttaacgagccagctcgcgagc

SEQ ID NO: 588 - DNA, 21 bp, Zea mays
cccgtgcgttgcaacggaaat

SEQ ID NO: 589 - DNA, 21 bp, Zea mays
aaagactttgccgagtgtcaa

SEQ ID NO: 590 - DNA, 21 bp, Zea mays
tcgcgagctaaacgagccaac

SEQ ID NO: 591 - DNA, 21 bp, Zea mays
ggcaaagtgtggcaagttagt

SEQ ID NO: 592 - DNA, 21 bp, Zea mays
gtgccaaccagactgcctcgc

SEQ ID NO: 593 - DNA, 21 bp, Zea mays
gatggacggccaagtcactcc

SEQ ID NO: 594 - DNA, 21 bp, Zea mays
agagctaaccgaacaagccgt

SEQ ID NO: 595 - DNA, 21 bp, Zea mays
aagatctatggcgccgagctc

SEQ ID NO: 596 - DNA, 21 bp, Zea mays
gccaagatctatggcgccgag

SEQ ID NO: 597 - DNA, 21 bp, Zea mays
ctgcgtgcagatgtggagcca

SEQ ID NO: 598 - DNA, 21 bp, Zea mays
gacacaaacgaacaaggttta

SEQ ID NO: 599 - DNA, 21 bp, Zea mays
tgaggccttgttcgtttacgt

SEQ ID NO: 600 - DNA, 21 bp, Zea mays
gtatccgacccgataggaccc

SEQ ID NO: 601 - DNA, 21 bp, Zea mays
ctgacgcagcaccattggatg

SEQ ID NO: 602 - DNA, 21 bp, Zea mays
accattggatgtggagggtat

SEQ ID NO: 603 - DNA, 21 bp, Zea mays
ctgtgccaaacagggcctaaa

SEQ ID NO: 604 - DNA, 21 bp, Zea mays
ataactaaccttaggtagaaa

SEQ ID NO: 605 - DNA, 21 bp, Zea mays
gtgtgactgatggtgggtcgc

SEQ ID NO: 606 - DNA, 21 bp, Zea mays
aagcccggcacggctattgaa

SEQ ID NO: 607 - DNA, 21 bp, Zea mays
gctaacttcctagaggcagcc

SEQ ID NO: 608 - DNA, 21 bp, Zea mays
aggtttccggcgtgcgcaggt

SEQ ID NO: 609 - DNA, 21 bp, Zea mays
gatgcattttgcgcatgggaa

SEQ ID NO: 610 - DNA, 21 bp, Zea mays
ataggctatgacgccgagctc

SEQ ID NO: 611 - DNA, 21 bp, Zea mays
aagagggtgtttggttgctgc

SEQ ID NO: 612 - DNA, 21 bp, Zea mays
cgaacgacgacaaccggtgag

SEQ ID NO: 613 - DNA, 21 bp, Zea mays
gaattcttgtgcgctgggacg

SEQ ID NO: 614 - DNA, 21 bp, Zea mays
atgggcctgtttggtttgtgt

SEQ ID NO: 615 - DNA, 21 bp, Zea mays
gcaaagcctttgccgagtgtt

SEQ ID NO: 616 - DNA, 21 bp, Zea mays
ttagctggaacgattccggtt

SEQ ID NO: 617 - DNA, 21 bp, Zea mays
gctgatttggtgaccagggaa

SEQ ID NO: 618 - DNA, 21 bp, Zea mays
agcagctgtgccaaacaaggc

SEQ ID NO: 619 - DNA, 21 bp, Zea mays
aggccttgttcgtttgtatcg

SEQ ID NO: 620 - DNA, 21 bp, Zea mays
ccgcgggggtcgcctgaggta

SEQ ID NO: 621 - DNA, 21 bp, Zea mays
atcgtcgtcgtcggccacggc

SEQ ID NO: 622 - DNA, 21 bp, Zea mays
ccgcgcttggggtcgacttgg

SEQ ID NO: 623 - DNA, 21 bp, Zea mays
tcattctaacagactctccaa

SEQ ID NO: 624 - DNA, 21 bp, Zea mays
gacacaaacgaacaaggacta

SEQ ID NO: 625 - DNA, 21 bp, Zea mays
aaggccttgttcgtttgtgac

SEQ ID NO: 626 - DNA, 21 bp, Zea mays
tagactatgtgtgtgggtcgg

SEQ ID NO: 627 - DNA, 21 bp, Zea mays
cagcaaaactgagggcacacg

SEQ ID NO: 628 - DNA, 21 bp, Zea mays
aaataaaaagaaacggaggga

SEQ ID NO: 629 - DNA, 21 bp, Zea mays
aattagaccatatttaatact

SEQ ID NO: 630 - DNA, 21 bp, Zea mays
tccaaatggtttaggattagg

SEQ ID NO: 631 - DNA, 21 bp, Zea mays
gaggctgaagctgagtcgcga

SEQ ID NO: 632 - DNA, 21 bp, Zea mays
ttgacagaagagagcgagcac

SEQ ID NO: 633 - DNA, 21 bp, Zea mays
aggaggaggccgggaagcggc

SEQ ID NO: 634 - DNA, 21 bp, Zea mays
gtgtctatgatttgtgggtcc

SEQ ID NO: 635 - DNA, 21 bp, Zea mays
tccgacccaccaatccagcag

SEQ ID NO: 636 - DNA, 21 bp, Zea mays
aaataaaaagaaacggagggg

SEQ ID NO: 637 - DNA, 21 bp, Zea mays
aaattagttttataatttgac

SEQ ID NO: 638 - DNA, 21 bp, Zea mays
ggcagtctccttggctagtcc

SEQ ID NO: 639 - DNA, 21 bp, Zea mays
gacggctgagatcgcagaatg

SEQ ID NO: 640 - DNA, 21 bp, Zea mays
gtcgcggggatagggcggacg

SEQ ID NO: 641 - DNA, 21 bp, Zea mays
gccataggctgtggcgctgag

SEQ ID NO: 642 - DNA, 21 bp, Zea mays
cacagcctatggcgccgagct

SEQ ID NO: 643 - DNA, 21 bp, Zea mays
cctgtttggttcgtggctaac

SEQ ID NO: 644 - DNA, 21 bp, Zea mays
ttagccacgaaccaaacaggt

SEQ ID NO: 645 - DNA, 21 bp, Zea mays
cacaaaaatgaggatagactc

SEQ ID NO: 646 - DNA, 21 bp, Zea mays
gaggaatggacccatgatgca

SEQ ID NO: 647 - DNA, 21 bp, Zea mays
ggcgtcgtcgtcggatgcggt

SEQ ID NO: 648 - DNA, 21 bp, Zea mays
agctcggcgccaagatctgtg

SEQ ID NO: 649 - DNA, 21 bp, Zea mays
tcctgcctcgatgccggcggc

SEQ ID NO: 650 - DNA, 21 bp, Zea mays
tgcccgtgcgttgcaacggta

SEQ ID NO: 651 - DNA, 21 bp, Zea mays
tcgtgatccattaccacccct

SEQ ID NO: 652 - DNA, 21 bp, Zea mays
cacaaaaatgaggataggtcc

SEQ ID NO: 653 - DNA, 21 bp, Zea mays
gttggaccgttgcagagtgga

SEQ ID NO: 654 - DNA, 21 bp, Zea mays
gccggattggtgggtcggaac

SEQ ID NO: 655 - DNA, 21 bp, Zea mays
gcctgtttggttcgtggctaa

SEQ ID NO: 656 - DNA, 21 bp, Zea mays
tggtgcacggttctgccatac

SEQ ID NO: 657 - DNA, 21 bp, Zea mays
acagttagccacgaaccaaac

SEQ ID NO: 658 - DNA, 21 bp, Zea mays
agggtctgtttggttcgtggc

SEQ ID NO: 659 - DNA, 21 bp, Zea mays
aggcggttttgtcttagggtc

SEQ ID NO: 660 - DNA, 21 bp, Zea mays
cggacgaaaccggtatgagcc

SEQ ID NO: 661 - DNA, 21 bp, Zea mays
ttagccacgaaccaaacatgc

SEQ ID NO: 662 - DNA, 21 bp, Zea mays
gtgtcggattgcactcgaaat

SEQ ID NO: 663 - DNA, 21 bp, Zea mays
gtggccgccgacgacgacggc

SEQ ID NO: 664 - DNA, 21 bp, Zea mays
ggtaccgtcgaacttaatggg

SEQ ID NO: 665 - DNA, 21 bp, Zea mays
cctcacaaaaaggaggataga

SEQ ID NO: 666 - DNA, 21 bp, Zea mays
tgggtatgctgctcaagttct

SEQ ID NO: 667 - DNA, 21 bp, Zea mays
cttttcgggcttgggccggac

SEQ ID NO: 668 - DNA, 21 bp, Zea mays
agtccctagaaaccaaacaac

SEQ ID NO: 669 - DNA, 21 bp, Zea mays
agtccctagaaaccaaacatc

SEQ ID NO: 670 - DNA, 21 bp, Zea mays
ctaagggccagtttggtaact

SEQ ID NO: 671 - DNA, 21 bp, Zea mays
ccggtcatgtgatgagtggcg

SEQ ID NO: 672 - DNA, 21 bp, Zea mays
acacaaacgaacaaggcctta

SEQ ID NO: 673 - DNA, 21 bp, Zea mays
ttagccacgaaccaaacaggc

SEQ ID NO: 674 - DNA, 21 bp, Zea mays
ccgcgccagattggcctccac

SEQ ID NO: 675 - DNA, 21 bp, Zea mays
ggactggccgactgggagaga

SEQ ID NO: 676 - DNA, 21 bp, Zea mays
aaagtcaaacgcttgatgtga

SEQ ID NO: 677 - DNA, 21 bp, Zea mays
cgggctaaactttagcagggg

SEQ ID NO: 678 - DNA, 21 bp, Zea mays
gggcctgtttggtttgatgcc

SEQ ID NO: 679 - DNA, 21 bp, Zea mays
ttgcaacgcacgggcacatac

SEQ ID NO: 680 - DNA, 21 bp, Zea mays
agcgggagagcaagcagaccg

SEQ ID NO: 681 - DNA, 21 bp, Zea mays
ttagccacgaaccaaacaagc

SEQ ID NO: 682 - DNA, 21 bp, Zea mays
agccggctgcaaaccaggata

SEQ ID NO: 683 - DNA, 21 bp, Zea mays
cacctcgtacacggccgccga

SEQ ID NO: 684 - DNA, 21 bp, Zea mays
gggggtgtttggtttctaagg

SEQ ID NO: 685 - DNA, 21 bp, Zea mays
caatcccctccggttttgtgg

SEQ ID NO: 686 - DNA, 21 bp, Zea mays
gagccacaaaaccggagggga

SEQ ID NO: 687 - DNA, 21 bp, Zea mays
ggaggggattggaggggctag

SEQ ID NO: 688 - DNA, 21 bp, Zea mays
ggagctatcccaaacagtgcc

SEQ ID NO: 689 - DNA, 21 bp, Zea mays
ccctaatcaccaaatcagccc

SEQ ID NO: 690 - DNA, 21 bp, Zea mays
aagggctgatttggtgacccg

SEQ ID NO: 691 - DNA, 21 bp, Zea mays
gggacggatacaggacgggac

SEQ ID NO: 692 - DNA, 21 bp, Zea mays
ggagatgaagggcgtcggggg

SEQ ID NO: 693 - DNA, 21 bp, Zea mays
gggcctgtttggtttgatgac

SEQ ID NO: 694 - DNA, 21 bp, Zea mays
cctgtttggttcgtggctata

SEQ ID NO: 695 - DNA, 21 bp, Zea mays
gctgtctacgatgccgtcgga

SEQ ID NO: 696 - DNA, 21 bp, Zea mays
tcggcggcgaggtactccagg

SEQ ID NO: 697 - DNA, 21 bp, Zea mays
cagatcttggcgccgaggtgt

SEQ ID NO: 698 - DNA, 21 bp, Zea mays
ctcgcgagctaaacgagccga

SEQ ID NO: 699 - DNA, 21 bp, Zea mays
gggcctgtttggtttgatggc

SEQ ID NO: 700 - DNA, 21 bp, Zea mays
actaaggggctgtttggttcg

SEQ ID NO: 701 - DNA, 21 bp, Zea mays
actgctgacgggagggaaggg

SEQ ID NO: 702 - DNA, 21 bp, Zea mays
agggtctgtttggttcgtgac

SEQ ID NO: 703 - DNA, 21 bp, Zea mays
aggtgagtgcccgtgcgatgc

SEQ ID NO: 704 - DNA, 21 bp, Zea mays
gctgctggtcctgtgcgctgt

SEQ ID NO: 705 - DNA, 21 bp, Zea mays
gggcctgtttggtttgtgcct

SEQ ID NO: 706 - DNA, 21 bp, Zea mays
aggtgagtgcccgtgcgttgc

SEQ ID NO: 707 - DNA, 21 bp, Zea mays
ggacggctgagatcgcagaat

SEQ ID NO: 708 - DNA, 21 bp, Zea mays
cacccccccccccccccccca

SEQ ID NO: 709 - DNA, 21 bp, Zea mays
caaagatccctcggtgctccg

SEQ ID NO: 710 - DNA, 21 bp, Zea mays
gaaccaaacaggcccataacc

SEQ ID NO: 711 - DNA, 21 bp, Zea mays
tgggcctgtttggttcgtggc

SEQ ID NO: 712 - DNA, 21 bp, Zea mays
ggccacgagcgtgcccgccca

SEQ ID NO: 713 - DNA, 21 bp, Zea mays
aagggctgatttggtgactag

SEQ ID NO: 714 - DNA, 21 bp, Zea mays
cccccaaggcaggcatgggcc

SEQ ID NO: 715 - DNA, 21 bp, Zea mays
cgagtctcaaattccgacccg

SEQ ID NO: 716 - DNA, 21 bp, Zea mays
gtggtccggcggcaggaaccg

SEQ ID NO: 717 - DNA, 21 bp, Zea mays
acaaaccaaacaagccctagt

SEQ ID NO: 718 - DNA, 21 bp, Zea mays
cttgggccagattggagtttc

SEQ ID NO: 719 - DNA, 21 bp, Zea mays
accaacgacctccgggccgaa

SEQ ID NO: 720 - DNA, 21 bp, Zea mays
ggagctatcccaaacagagcc

SEQ ID NO: 721 - DNA, 21 bp, Zea mays
cagagcggttgaggtcgtggg

SEQ ID NO: 722 - DNA, 21 bp, Zea mays
cagtcccgcgtgtcagtgacc

SEQ ID NO: 723 - DNA, 21 bp, Zea mays
gaaccaaacagcacgctaagt

SEQ ID NO: 724 - DNA, 21 bp, Zea mays
cggaatcgcgttctttgccga

SEQ ID NO: 725 - DNA, 21 bp, Zea mays
aagggctgatttggtgaccag

SEQ ID NO: 726 - DNA, 21 bp, Zea mays
gttcgtcgccggagagtcgcc

SEQ ID NO: 727 - DNA, 21 bp, Zea mays
caccggacgcaccgattttca

SEQ ID NO: 728 - DNA, 21 bp, Zea mays
gttcgtttccgtcggattgca

SEQ ID NO: 729 - DNA, 21 bp, Zea mays
ccgacgaagcaggggctgcga

SEQ ID NO: 730 - DNA, 21 bp, Zea mays
agggctctacacaggaaaaac

SEQ ID NO: 731 - DNA, 21 bp, Zea mays
agaactgctgctgctgctggt

SEQ ID NO: 732 - DNA, 21 bp, Zea mays
ttccttatgtccgacggcttt

SEQ ID NO: 733 - DNA, 21 bp, Zea mays
cctcacaaaaaggaggataaa

SEQ ID NO: 734 - DNA, 21 bp, Zea mays
tgtgaggggctgcaaacagcc

SEQ ID NO: 735 - DNA, 21 bp, Zea mays
caggctgtttgcagcccctca

SEQ ID NO: 736 - DNA, 21 bp, Zea mays
ttcgtttgcgtcggattgcac

SEQ ID NO: 737 - DNA, 21 bp, Zea mays
gttcgtttccgtcggattggt

SEQ ID NO: 738 - DNA, 21 bp, Zea mays
aaacttggaacggttctgggc

SEQ ID NO: 739 - DNA, 21 bp, Zea mays
gggggtgtttggtttctatga

SEQ ID NO: 740 - DNA, 21 bp, Zea mays
gtgctcgtgccacgtgctgct

SEQ ID NO: 741 - DNA, 21 bp, Zea mays
gagggtgcgaatgttgcggtt

SEQ ID NO: 742 - DNA, 21 bp, Zea mays
gatctgtgtttgtgggcctcc

SEQ ID NO: 743 - DNA, 21 bp, Zea mays
acgcccttgacaacctggtat

SEQ ID NO: 744 - DNA, 21 bp, Zea mays
ggaacgattccgggtgcaatc

SEQ ID NO: 745 - DNA, 21 bp, Zea mays
ggttacgatgtcctatgcgcc

SEQ ID NO: 746 - DNA, 21 bp, Zea mays
caaagatccctcggtgctttg

SEQ ID NO: 747 - DNA, 21 bp, Zea mays
cccctccctccctccctccca

SEQ ID NO: 748 - DNA, 21 bp, Zea mays
gacggtgacggtgacggcgac

SEQ ID NO: 749 - DNA, 21 bp, Zea mays
agggctgatttggtgaccggg

SEQ ID NO: 750 - DNA, 21 bp, Zea mays
tgtccgtgcgttgcgacggga

SEQ ID NO: 751 - DNA, 21 bp, Zea mays
gggtcccgctctggctgattg

SEQ ID NO: 752 - DNA, 21 bp, Zea mays
cttgcacgcttgcacataaga

SEQ ID NO: 753 - DNA, 21 bp, Zea mays
acatccctgtcctggttgtcc

SEQ ID NO: 754 - DNA, 21 bp, Zea mays
tgaaccaaacaggccctttcg

SEQ ID NO: 755 - DNA, 21 bp, Zea mays
ggtgactggtccagtgctcac

SEQ ID NO: 756 - DNA, 21 bp, Zea mays
cagcgcaccacgtacaggtct

SEQ ID NO: 757 - DNA, 21 bp, Zea mays
cgttccgacccaccaatccag

SEQ ID NO: 758 - DNA, 21 bp, Zea mays
ccgagctggattgcttctcta

SEQ ID NO: 759 - DNA, 21 bp, Zea mays
gcagcggctgctggctccggc

SEQ ID NO: 760 - DNA, 21 bp, Zea mays
agtccctagaaaccaaatact

SEQ ID NO: 761 - DNA, 21 bp, Zea mays
ataggttgtttttcagaaaga

SEQ ID NO: 762 - DNA, 21 bp, Zea mays
gaaccgaaccgaagaaccgag

SEQ ID NO: 763 - DNA, 21 bp, Zea mays
ccgaactaaccgaaccgagga

SEQ ID NO: 764 - DNA, 21 bp, Zea mays
caggccttgttcgtttgtacc

SEQ ID NO: 765 - DNA, 21 bp, Zea mays
gtagcagtgcttgcgtgctag

SEQ ID NO: 766 - DNA, 21 bp, Zea mays
agacgaccgacggcggcgtct

SEQ ID NO: 767 - DNA, 21 bp, Zea mays
caaccaaacgcaccctaagtt

SEQ ID NO: 768 - DNA, 21 bp, Zea mays
cgagctgtgttacctcggcgc

SEQ ID NO: 769 - DNA, 21 bp, Zea mays
gccagaaattgtgtgctttgg

SEQ ID NO: 770 - DNA, 21 bp, Zea mays
gcatcgttcacgtgggcgaga

SEQ ID NO: 771 - DNA, 21 bp, Zea mays
agggctgatttggtgacccgg

SEQ ID NO: 772 - DNA, 21 bp, Zea mays
tcccctccggttttgtggcta

SEQ ID NO: 773 - DNA, 21 bp, Zea mays
aaaaagcactcggcaaagcgc

SEQ ID NO: 774 - DNA, 21 bp, Zea mays
cacgggtacgggtttgggacg

SEQ ID NO: 775 - DNA, 21 bp, Zea mays
gtgagagaggagagcggagga

SEQ ID NO: 776 - DNA, 21 bp, Zea mays
gctcacaaggtgccacggccc

SEQ ID NO: 777 - DNA, 21 bp, Zea mays
cagcgcaccacgtacaggtcg

SEQ ID NO: 778 - DNA, 21 bp, Zea mays
gcagcggctgctggctcccac

SEQ ID NO: 779 - DNA, 21 bp, Zea mays
aggcaggcaggcaggcagaca

SEQ ID NO: 780 - DNA, 21 bp, Zea mays
caccacaactgcggcgcggga

SEQ ID NO: 781 - DNA, 21 bp, Zea mays
gggggtgtttggtttctagag

SEQ ID NO: 782 - DNA, 21 bp, Zea mays
tgcgtcgtgcgggctgctcga

SEQ ID NO: 783 - DNA, 21 bp, Zea mays
caggccttgttcgtttgggtc

SEQ ID NO: 784 - DNA, 21 bp, Zea mays
ctggcacgtgacccgaaccgg

SEQ ID NO: 785 - DNA, 21 bp, Zea mays
gacttttctggcaagtcgggc

SEQ ID NO: 786 - DNA, 21 bp, Zea mays
gttcgtttccgtcggattata

SEQ ID NO: 787 - DNA, 21 bp, Zea mays
cgaggccgtggaatgcggacg

SEQ ID NO: 788 - DNA, 21 bp, Zea mays
gagggctagtttgggagccac

SEQ ID NO: 789 - DNA, 21 bp, Zea mays
gggggtgtttggtttctaaga

SEQ ID NO: 790 - DNA, 21 bp, Zea mays
gaggaatggacccatgatgta

SEQ ID NO: 791 - DNA, 21 bp, Zea mays
atgtttggtttgtggctaact

SEQ ID NO: 792 - DNA, 21 bp, Zea mays
caggggcagagatccgcgcca

SEQ ID NO: 793 - DNA, 21 bp, Zea mays
agcaacttcttaagttgtggg

SEQ ID NO: 794 - DNA, 21 bp, Zea mays
aagggctgatttggtgatcag

SEQ ID NO: 795 - DNA, 21 bp, Zea mays
ccttcagccttgaccaacctc

SEQ ID NO: 796 - DNA, 21 bp, Zea mays
agtcagccgtaggaagttagt

SEQ ID NO: 797 - DNA, 21 bp, Zea mays
gggggtgtttggtttctatgg

SEQ ID NO: 798 - DNA, 21 bp, Zea mays
gctcgacagggacttggtcgt

SEQ ID NO: 799 - DNA, 21 bp, Zea mays
ttgcaacgcacgggcactcac

SEQ ID NO: 800 - DNA, 21 bp, Zea mays
agtccctagaaaccaaacact

SEQ ID NO: 801 - DNA, 21 bp, Zea mays
ttgcaacgcacgggcactgac

SEQ ID NO: 802 - DNA, 21 bp, Zea mays
gggccattgcagagtgggcgg

SEQ ID NO: 803 - DNA, 21 bp, Zea mays
ttttcatctcccgcagcggtt

SEQ ID NO: 804 - DNA, 21 bp, Zea mays
gagtcatgttggctagaggat

SEQ ID NO: 805 - DNA, 21 bp, Zea mays
gtgttggcggctagctcccat

SEQ ID NO: 806 - DNA, 21 bp, Zea mays
aagggctgatttggtgaccct

SEQ ID NO: 807 - DNA, 21 bp, Zea mays
cacgaccgtgatggacctaac

SEQ ID NO: 808 - DNA, 21 bp, Zea mays
ttagccacgaaccaaacaacc

SEQ ID NO: 809 - DNA, 21 bp, Zea mays
accaacgacctccgggcagag

SEQ ID NO: 810 - DNA, 21 bp, Zea mays
ttagccacgaaccaaacgacg

SEQ ID NO: 811 - DNA, 21 bp, Zea mays
agtccctagaaaccaaacccc

SEQ ID NO: 812 - DNA, 21 bp, Zea mays
gttcgtttccgtcggatggca

SEQ ID NO: 813 - DNA, 21 bp, Zea mays
gcaaccgaacaggcccttagg

SEQ ID NO: 814 - DNA, 21 bp, Zea mays
gaaccaaacaggccctaagtg

SEQ ID NO: 815 - DNA, 21 bp, Zea mays
cagagacaggcgtgtgggtcc

SEQ ID NO: 816 - DNA, 21 bp, Zea mays
ggtacaaccgaacgggccctt

SEQ ID NO: 817 - DNA, 21 bp, Zea mays
ttcttcgcgggtacgggtttg

SEQ ID NO: 818 - DNA, 21 bp, Zea mays
agtccctagaaaccaaacaca

SEQ ID NO: 819 - DNA, 21 bp, Zea mays
aagggctgatttggtgatcaa

SEQ ID NO: 820 - DNA, 21 bp, Zea mays
gtggcatcgcacgggcaccta

SEQ ID NO: 821 - DNA, 21 bp, Zea mays
aagcggcacactgcgtagcgc

SEQ ID NO: 822 - DNA, 21 bp, Zea mays
gcccgcccgcccgcccgcgtg

SEQ ID NO: 823 - DNA, 21 bp, Zea mays
ttagccacgaaccaaacatgt

SEQ ID NO: 824 - DNA, 21 bp, Zea mays
ccgctaagccgtcggacataa

SEQ ID NO: 825 - DNA, 21 bp, Zea mays
agaggccagaggcccaatcct

SEQ ID NO: 826 - DNA, 21 bp, Zea mays
agtgctggcacggacacaata

SEQ ID NO: 827 - DNA, 21 bp, Zea mays
ttagccacgaaccaaacgtgc

SEQ ID NO: 828 - DNA, 21 bp, Zea mays
cgtgggaggccgtgtcgcaga

SEQ ID NO: 829 - DNA, 21 bp, Zea mays
tgctcgtacgatgccacggaa

SEQ ID NO: 830 - DNA, 21 bp, Zea mays
ggagctatcccaaacagggtc

SEQ ID NO: 831 - DNA, 21 bp, Zea mays
gggcacagctgagcaaaaaac

SEQ ID NO: 832 - DNA, 21 bp, Zea mays
cgggtcttcggctgcctcgcg

SEQ ID NO: 833 - DNA, 21 bp, Zea mays
acacaaacgaacaaggcccaa

SEQ ID NO: 834 - DNA, 21 bp, Zea mays
gcgatggcggcggtgtcccgg

SEQ ID NO: 835 - DNA, 21 bp, Zea mays
gtggcaagttaggcatcaaac

SEQ ID NO: 836 - DNA, 21 bp, Zea mays
gttgacgccggcccgttagtg

SEQ ID NO: 837 - DNA, 21 bp, Zea mays
ccacaaaccaaacaggcccga

SEQ ID NO: 838 - DNA, 21 bp, Zea mays
tgcggtgcccgccgcccggca

SEQ ID NO: 839 - DNA, 21 bp, Zea mays
agactcagctagtgcttatgg

SEQ ID NO: 840 - DNA, 21 bp, Zea mays
ccttgttggaggcgtagggga

SEQ ID NO: 841 - DNA, 21 bp, Zea mays
  unsure (20)..(21): n = A, C, G or T
agtccctagaaaccaaacann

SEQ ID NO: 842 - DNA, 21 bp, Zea mays
gacgacgacggaggcgagagg

SEQ ID NO: 843 - DNA, 21 bp, Zea mays
tcggctcggctcggctctctt

SEQ ID NO: 844 - DNA, 21 bp, Zea mays
ggaacaacaggcaccgagatc

SEQ ID NO: 845 - DNA, 21 bp, Zea mays
aggctatctccagcaggtttg

SEQ ID NO: 846 - DNA, 21 bp, Zea mays
aggctaatccaacagacttgg

SEQ ID NO: 847 - DNA, 21 bp, Zea mays
gagggctagtttgggagtcca

SEQ ID NO: 848 - DNA, 21 bp, Zea mays
cgagctccaggcgaggcggct

SEQ ID NO: 849 - DNA, 21 bp, Zea mays
catgggccaggctgggccaaa

SEQ ID NO: 850 - DNA, 21 bp, Zea mays
aggcaaagtgtgacaagttag

SEQ ID NO: 851 - DNA, 21 bp, Zea mays
gtacgaggccgtcggagataa

SEQ ID NO: 852 - DNA, 21 bp, Zea mays
tttttgacactcggcaaagag

SEQ ID NO: 853 - DNA, 21 bp, Zea mays
agagcttcttcgccgagtgtt

SEQ ID NO: 854 - DNA, 21 bp, Zea mays
ggctgcgttggtaatcggctg

SEQ ID NO: 855 - DNA, 21 bp, Zea mays
cgtgccaaatggattcgaacc

SEQ ID NO: 856 - DNA, 21 bp, Zea mays
aggtgagtgcccgtgcgttac

SEQ ID NO: 857 - DNA, 21 bp, Zea mays
aggtgagtgcccgtgcgtcgc

SEQ ID NO: 858 - DNA, 21 bp, Zea mays
ctgtcccggctactgcaactc

SEQ ID NO: 859 - DNA, 21 bp, Zea mays
ctggacaaaatgctcgttgtt

SEQ ID NO: 860 - DNA, 21 bp, Zea mays
atagcctatggcgccgagcat

SEQ ID NO: 861 - DNA, 21 bp, Zea mays
caccaccaggaggagggtaca

SEQ ID NO: 862 - DNA, 21 bp, Zea mays
ccctggggcccattggtcaga

SEQ ID NO: 863 - DNA, 21 bp, Zea mays
tatagcgccgagcaaagggtc

SEQ ID NO: 864 - DNA, 21 bp, Zea mays
cgcgtgctagggtttggcgcc

SEQ ID NO: 865 - DNA, 21 bp, Zea mays
agggtctgtttggttcgctgc

SEQ ID NO: 866 - DNA, 21 bp, Zea mays
acgggtgagttcgcctgtcga

SEQ ID NO: 867 - DNA, 21 bp, Zea mays
gcctgtttggttcgtggttaa

SEQ ID NO: 868 - DNA, 21 bp, Zea mays
agtccctagaaaccaaacacg

SEQ ID NO: 869 - DNA, 21 bp, Zea mays
agccgcagcgaacaagccgtg

SEQ ID NO: 870 - DNA, 21 bp, Zea mays
gtgtgacattgcagcgtggac

SEQ ID NO: 871 - DNA, 21 bp, Zea mays
ggagtggctgtctgcgggatt

SEQ ID NO: 872 - DNA, 21 bp, Zea mays
attgctgctgcgggtgattgt

SEQ ID NO: 873 - DNA, 21 bp, Zea mays
cctccggttttgtggcttcta

SEQ ID NO: 874 - DNA, 21 bp, Zea mays
acacaaacgaacaaggcctga

SEQ ID NO: 875 - DNA, 21 bp, Zea mays
aaactttagcaggagcaacca

SEQ ID NO: 876 - DNA, 21 bp, Zea mays
atgtttggtttgtggctaaat

SEQ ID NO: 877 - DNA, 21 bp, Zea mays
gagcacgcgtgaagcccgatg

SEQ ID NO: 878 - DNA, 21 bp, Zea mays
acgagccgagtcgagccacca

SEQ ID NO: 879 - DNA, 21 bp, Zea mays
gccggatcggaggatgtcatg

SEQ ID NO: 880 - DNA, 21 bp, Zea mays
agggctgatttggtgactagg

SEQ ID NO: 881 - DNA, 21 bp, Zea mays
tgtttggttgcgagacagcca

SEQ ID NO: 882 - DNA, 21 bp, Zea mays
gttgcaatgacaggacgggac

SEQ ID NO: 883 - DNA, 21 bp, Zea mays
cactatgtgtcgtgccgggcc

SEQ ID NO: 884 - DNA, 21 bp, Zea mays
tcgtatctggtgagcctggcc

SEQ ID NO: 885 - DNA, 21 bp, Zea mays
cgcatctccagagccaggctc

SEQ ID NO: 886 - DNA, 21 bp, Zea mays
gagtcatgttggctagagggt

SEQ ID NO: 887 - DNA, 21 bp, Zea mays
cggcggctacaccggcggcta

SEQ ID NO: 888 - DNA, 21 bp, Zea mays
cggctgcggctgcggctggta

SEQ ID NO: 889 - DNA, 21 bp, Zea mays
acaaaccaaacaagccctagg

SEQ ID NO: 890 - DNA, 21 bp, Zea mays
gcaccaagatctgtggcgcct

SEQ ID NO: 891 - DNA, 21 bp, Zea mays
cagcagaaacaaacgagccct

SEQ ID NO: 892 - DNA, 21 bp, Zea mays
aggcaggcaggcaggcagcgt

SEQ ID NO: 893 - DNA, 21 bp, Zea mays
agactgtcttcagcggttgcc

SEQ ID NO: 894 - DNA, 21 bp, Zea mays
tccttgcgcacaagatacgtt

SEQ ID NO: 895 - DNA, 21 bp, Zea mays
atgtttggtttgtggctaatt

SEQ ID NO: 896 - DNA, 21 bp, Zea mays
acgcttgatgtgacccgggct

SEQ ID NO: 897 - DNA, 21 bp, Zea mays
gaagatcgtgtggctggcaag

SEQ ID NO: 898 - DNA, 21 bp, Zea mays
cacgggtacgggtttgggata

SEQ ID NO: 899 - DNA, 21 bp, Zea mays
gggctgactggtgttgggcct

SEQ ID NO: 900 - DNA, 21 bp, Zea mays
gcgacatacgcagggcagccg

SEQ ID NO: 901 - DNA, 21 bp, Zea mays
gcgtagcattgggcgtgtgtg

SEQ ID NO: 902 - DNA, 21 bp, Zea mays
gccataggctgtggcgccgag

SEQ ID NO: 903 - DNA, 21 bp, Zea mays
gtatctcgggagccaggccca

SEQ ID NO: 904 - DNA, 21 bp, Zea mays
gttcgtttccgtcggattgta

SEQ ID NO: 905 - DNA, 21 bp, Zea mays
gtaaccgtggacgtaacaggg

SEQ ID NO: 906 - DNA, 21 bp, Zea mays
agaggtgacgtagaggaggac

SEQ ID NO: 907 - DNA, 21 bp, Zea mays
cttgcacgcttgcacataagg

SEQ ID NO: 908 - DNA, 21 bp, Zea mays
gggggtgtttggtttctaggt

SEQ ID NO: 909 - DNA, 21 bp, Zea mays
gaaccaaacaggcccatatat

SEQ ID NO: 910 - DNA, 21 bp, Zea mays
gcggcttgctgcggctttaat

SEQ ID NO: 911 - DNA, 21 bp, Zea mays
ccagcaggccatgtaaacgtc

SEQ ID NO: 912 - DNA, 21 bp, Zea mays
ttagccacgaaccaaacagtc

SEQ ID NO: 913 - DNA, 21 bp, Zea mays
acacaaacgaacaaggcacta

SEQ ID NO: 914 - DNA, 21 bp, Zea mays
gccgcagcggtgtcccctggc

SEQ ID NO: 915 - DNA, 21 bp, Zea mays
agtccctagaaaccaaacgac

SEQ ID NO: 916 - DNA, 21 bp, Zea mays
cgttcctgagcaaccgaacag

SEQ ID NO: 917 - DNA, 21 bp, Zea mays
agatcgtgtttggagcgagct

SEQ ID NO: 918 - DNA, 21 bp, Zea mays
  unsure (21): n = A, C, G or T
cgccataggctatggcgccgn

SEQ ID NO: 919 - DNA, 21 bp, Zea mays
caaagtaggatgagtcggggg

SEQ ID NO: 920 - DNA, 21 bp, Zea mays
gaaccaaacagcacgctagtg

SEQ ID NO: 921 - DNA, 21 bp, Zea mays
aaccgaacaagccctaatggg

SEQ ID NO: 922 - DNA, 21 bp, Zea mays
ttggtgtaaccgaacatggcc

SEQ ID NO: 923 - DNA, 21 bp, Zea mays
tgagctcgctcgactcgtggc

SEQ ID NO: 924 - DNA, 21 bp, Zea mays
tgtttggttgcgagacagtca

SEQ ID NO: 925 - DNA, 21 bp, Zea mays
gaagcacgataggcttgctcc

SEQ ID NO: 926 - DNA, 21 bp, Zea mays
gagccacaaaaccggagagga

SEQ ID NO: 927 - DNA, 21 bp, Zea mays
cccgagggggatcgaactcgg

SEQ ID NO: 928 - DNA, 21 bp, Zea mays
tgcccgtgcgttgcaacggga

SEQ ID NO: 929 - DNA, 21 bp, Zea mays
agtccctagaaaccaaatacc

SEQ ID NO: 930 - DNA, 21 bp, Zea mays
tctaggctttgccgagtgctt

SEQ ID NO: 931 - DNA, 21 bp, Zea mays
ctgccgcaggcttggttccta

SEQ ID NO: 932 - DNA, 21 bp, Zea mays
gcctcgctgggttgctcggcg

SEQ ID NO: 933 - DNA, 21 bp, Zea mays
gaagcccagggctcccgttat

SEQ ID NO: 934 - DNA, 21 bp, Zea mays
tgccgccggagcgctccagga

SEQ ID NO: 935 - DNA, 21 bp, Zea mays
aagtcaaacacttgatgtgac

SEQ ID NO: 936 - DNA, 21 bp, Zea mays
gagggctagtttgggagcaat

SEQ ID NO: 937 - DNA, 21 bp, Zea mays
gcaatccggtcaggaatcgtt

SEQ ID NO: 938 - DNA, 21 bp, Zea mays
ggtaccgtcgaacttaaggtt

SEQ ID NO: 939 - DNA, 21 bp, Zea mays
ggaggggattggaggggttag

SEQ ID NO: 940 - DNA, 21 bp, Zea mays
agcggtccgctacgaaggggg

SEQ ID NO: 941 - DNA, 21 bp, Zea mays
acggtagtgttgagcgccttg

SEQ ID NO: 942 - DNA, 21 bp, Zea mays
acggcgaggtggactaactgc

SEQ ID NO: 943 - DNA, 21 bp, Zea mays
ttggtgtaaccgaacatgccc

SEQ ID NO: 944 - DNA, 21 bp, Zea mays
ttggtgtaaccgaacaagtcc

SEQ ID NO: 945 - DNA, 21 bp, Zea mays
catagacggagtggtagggga

SEQ ID NO: 946 - DNA, 21 bp, Zea mays
cagtcgggtgggccgcttcaa

SEQ ID NO: 947 - DNA, 21 bp, Zea mays
agtcagccgtaggaagttagc

SEQ ID NO: 948 - DNA, 21 bp, Zea mays
tggggcgacgactcggctagc

SEQ ID NO: 949 - DNA, 21 bp, Zea mays
acacaaacgaacaaggcttaa

SEQ ID NO: 950 - DNA, 21 bp, Zea mays
ggggctttgccgagtgtcaaa

SEQ ID NO: 951 - DNA, 21 bp, Zea mays
aggctcacgggccgtgcctgg

SEQ ID NO: 952 - DNA, 21 bp, Zea mays
attcatcagtccagcaggctt

SEQ ID NO: 953 - DNA, 21 bp, Zea mays
acttttggtgtttggttcgct

SEQ ID NO: 954 - DNA, 21 bp, Zea mays
gagggctagtttgggagccat

SEQ ID NO: 955 - DNA, 21 bp, Zea mays
tttttgacactcggcaaaaaa

SEQ ID NO: 956 - DNA, 21 bp, Zea mays
ttagccacgaaccaaacggcc

SEQ ID NO: 957 - DNA, 21 bp, Zea mays
gtcgggattccttccaggcgg

SEQ ID NO: 958 - DNA, 21 bp, Zea mays
cacgttgctgccaaactagcc

SEQ ID NO: 959 - DNA, 21 bp, Zea mays
ctccagcaacgtcctctaaac

SEQ ID NO: 960 - DNA, 21 bp, Zea mays
cttgcatgtttgtgggggccc

SEQ ID NO: 961 - DNA, 21 bp, Zea mays
gccgccgccatcgtcgttatg

SEQ ID NO: 962 - DNA, 21 bp, Zea mays
cggccaaagccgtcggacata

SEQ ID NO: 963 - DNA, 21 bp, Zea mays
gcctcgctgggttgctcgacg

SEQ ID NO: 964 - DNA, 21 bp, Zea mays
gaaaaccgacgggaataagcc

SEQ ID NO: 965 - DNA, 21 bp, Zea mays
gagtcggtacaggaaaccaaa

SEQ ID NO: 966 - DNA, 21 bp, Zea mays
agtgtgacactcggcaaagag

SEQ ID NO: 967 - DNA, 21 bp, Zea mays
aagggctgatttggtgatccg

SEQ ID NO: 968 - DNA, 21 bp, Zea mays
gctctgtttggcacagcttat

SEQ ID NO: 969 - DNA, 21 bp, Zea mays
gtccatcgggtgacggatatg

SEQ ID NO: 970 - DNA, 21 bp, Zea mays
cagactgtttgcagcccctca

SEQ ID NO: 971 - DNA, 21 bp, Zea mays
tgtgaggggctgcaaacagtc

SEQ ID NO: 972 - DNA, 21 bp, Zea mays
tgcagaaaccgtcggcccagg

SEQ ID NO: 973 - DNA, 21 bp, Zea mays
attctcgtcgcgcggcttcac

SEQ ID NO: 974 - DNA, 21 bp, Zea mays
gagccacaaaaccggagagaa

SEQ ID NO: 975 - DNA, 21 bp, Zea mays
gccgtgcttgggcctgagtcg

SEQ ID NO: 976 - DNA, 21 bp, Zea mays
tctctcagcggcaggctggtg

SEQ ID NO: 977 - DNA, 21 bp, Zea mays
cgtgtccagcgagacgacagg

SEQ ID NO: 978 - DNA, 21 bp, Zea mays
cgtgccgtgcttgggccagca

SEQ ID NO: 979 - DNA, 21 bp, Zea mays
cgtgcaaggactagcagaagc

SEQ ID NO: 980 - DNA, 21 bp, Zea mays
cgggcactcggcaaagaagct

SEQ ID NO: 981 - DNA, 21 bp, Zea mays
ccgagactcggagagggcgtc

SEQ ID NO: 982 - DNA, 21 bp, Zea mays
tgcgcctagagaaggcccact

SEQ ID NO: 983 - DNA, 21 bp, Zea mays
gtgccgtgcctgggccagcac

SEQ ID NO: 984 - DNA, 21 bp, Zea mays
tggcccaggcacggcacgcag

SEQ ID NO: 985 - DNA, 21 bp, Zea mays
gggggtgtttggtttctaaag

SEQ ID NO: 986 - DNA, 21 bp, Zea mays
agtccctagaaaccaaacgcc

SEQ ID NO: 987 - DNA, 21 bp, Zea mays
gggcgcatgacagctattgca

SEQ ID NO: 988 - DNA, 21 bp, Zea mays
aaaacaccttccaacagggca

SEQ ID NO: 989 - DNA, 21 bp, Zea mays
ccagcggcccagccacgattg

SEQ ID NO: 990 - DNA, 21 bp, Zea mays
ccggtgcgcccatcgccacca

SEQ ID NO: 991 - DNA, 21 bp, Zea mays
agggactgcactgcgtacata

SEQ ID NO: 992 - DNA, 21 bp, Zea mays
tcggctcggctcggatcggat

SEQ ID NO: 993 - DNA, 21 bp, Zea mays
ccctaatcaccaaatcagtca

SEQ ID NO: 994 - DNA, 21 bp, Zea mays
tcggtctattcgggttctcga

SEQ ID NO: 995 - DNA, 21 bp, Zea mays
agggctgatttggtgaccagg

SEQ ID NO: 996 - DNA, 21 bp, Zea mays
aggcaggcaggcaggcagtga

SEQ ID NO: 997 - DNA, 21 bp, Zea mays
tccctccctccctcccttaaa

SEQ ID NO: 998 - DNA, 21 bp, Zea mays
ccgcgcagccagctactgcgc

SEQ ID NO: 999 - DNA, 21 bp, Zea mays
cccatgtgagaacgaccgcga

SEQ ID NO: 1000 - DNA, 21 bp, Zea mays
ccataaaccgagcaagccaac

SEQ ID NO: 1001 - DNA, 21 bp, Zea mays
agtccctagaaaccaaacata

SEQ ID NO: 1002 - DNA, 21 bp, Zea mays
tgcccgtgcgttgcaacggaa

SEQ ID NO: 1003 - DNA, 21 bp, Zea mays
agcaacgccgtgtatgtggat

SEQ ID NO: 1004 - DNA, 21 bp, Zea mays
actattggagttgctcttagc

SEQ ID NO: 1005 - DNA, 21 bp, Zea mays
aagggctgatttggtgaccat

SEQ ID NO: 1006 - DNA, 21 bp, Zea mays
agggctgatttggtgaccaga

SEQ ID NO: 1007 - DNA, 21 bp, Zea mays
ttagccacgaaccaaacagac

SEQ ID NO: 1008 - DNA, 21 bp, Zea mays
tggtgcacggttctgcctgca

SEQ ID NO: 1009 - DNA, 21 bp, Zea mays
ctcgcgagctaaacgagccaa

SEQ ID NO: 1010 - DNA, 21 bp, Zea mays
gaggcccaaacacgacccgct

SEQ ID NO: 1011 - DNA, 21 bp, Zea mays
cgtgccaaccagactgcctcg

SEQ ID NO: 1012 - DNA, 21 bp, Zea mays
gcagcggctgctggctcccgc

SEQ ID NO: 1013 - DNA, 21 bp, Zea mays
ggggattttctcggccgagac

SEQ ID NO: 1014 - DNA, 21 bp, Zea mays
ctgaagacccctgcgaaagga

SEQ ID NO: 1015 - DNA, 21 bp, Zea mays
cgggttcaggtgcgggtttag

SEQ ID NO: 1016 - DNA, 21 bp, Zea mays
gcacgcaggcgcacttgtcac

SEQ ID NO: 1017 - DNA, 21 bp, Zea mays
caaccaaacgcaccctaagta

SEQ ID NO: 1018 - DNA, 21 bp, Zea mays
atgtttggtttgtggctaaca

SEQ ID NO: 1019 - DNA, 21 bp, Zea mays
caggcactcggcaaagaagat

SEQ ID NO: 1020 - DNA, 21 bp, Zea mays
cgcagcaccattggatgtgga

SEQ ID NO: 1021 - DNA, 21 bp, Zea mays
cttgactggctcgtcttattc

SEQ ID NO: 1022 - DNA, 21 bp, Zea mays
tcggttttgctggtgtgctca

SEQ ID NO: 1023 - DNA, 21 bp, Zea mays
aggcaagccccggtgcatgca

SEQ ID NO: 1024 - DNA, 21 bp, Zea mays
caccggacagcacagagacgg

SEQ ID NO: 1025 - DNA, 21 bp, Zea mays
aagggctgatttggtgattag

SEQ ID NO: 1026 - DNA, 21 bp, Zea mays
agggggaaccgctgcgggaga

SEQ ID NO: 1027 - DNA, 21 bp, Zea mays
cgaacagggccttagggcgtg

SEQ ID NO: 1028 - DNA, 21 bp, Zea mays
gtattgccgaagccactggta

SEQ ID NO: 1029 - DNA, 21 bp, Zea mays
actcgacaaagcgtactgtgc

SEQ ID NO: 1030 - DNA, 21 bp, Zea mays
aggcaaagtgtgacaagttat

SEQ ID NO: 1031 - DNA, 21 bp, Zea mays
gctaatcgtgccgtgcccgtg

SEQ ID NO: 1032 - DNA, 21 bp, Zea mays
gcccgctgggttggggaagac

SEQ ID NO: 1033 - DNA, 21 bp, Zea mays
gcttatgtccgacggtctcct

SEQ ID NO: 1034 - DNA, 21 bp, Zea mays
gtgcccgtgcgttgcgacgga

SEQ ID NO: 1035 - DNA, 21 bp, Zea mays
gttgcaacgcacggacactca

SEQ ID NO: 1036 - DNA, 21 bp, Zea mays
agggctgggaagacactcgca

SEQ ID NO: 1037 - DNA, 21 bp, Zea mays
cagtttcaacggtcgtcacac

SEQ ID NO: 1038 - DNA, 21 bp, Zea mays
agcggcggcggcggcttcgcg

SEQ ID NO: 1039 - DNA, 21 bp, Zea mays
gttgcgggacagccaggacag

SEQ ID NO: 1040 - DNA, 21 bp, Zea mays
agtccctagaaaccaaacagc

SEQ ID NO: 1041 - DNA, 21 bp, Zea mays
gggcctgtttggtttgtgtca

SEQ ID NO: 1042 - DNA, 21 bp, Zea mays
tggaacgattccggttgcaat

SEQ ID NO: 1043 - DNA, 21 bp, Zea mays
gtcgcgtggtccgtgtgcgtc

SEQ ID NO: 1044 - DNA, 21 bp, Zea mays
tggtttgcatccgggctgcac

SEQ ID NO: 1045 - DNA, 21 bp, Zea mays
ggtgttgcgacaccgtctatt

SEQ ID NO: 1046 - DNA, 21 bp, Zea mays
aggcaggcaggcaggcagagc

SEQ ID NO: 1047 - DNA, 21 bp, Zea mays
cgtcgtgccgacccatttatc

SEQ ID NO: 1048 - DNA, 21 bp, Zea mays
gagggctagtttgggaggctc

SEQ ID NO: 1049 - DNA, 21 bp, Zea mays
cgtgagttctccgctgctttc

SEQ ID NO: 1050 - DNA, 21 bp, Zea mays
ctccagcaacgtcctctatat

SEQ ID NO: 1051 - DNA, 21 bp, Zea mays
agtagcaacagacgtcttatt

SEQ ID NO: 1052 - DNA, 21 bp, Zea mays
cgcttggggtcgacttggctt

SEQ ID NO: 1053 - DNA, 21 bp, Zea mays
acgcttgatgtgacccggact

SEQ ID NO: 1054 - DNA, 21 bp, Zea mays
agggtctgtttggttcgctga

SEQ ID NO: 1055 - DNA, 21 bp, Zea mays
ctggtttgctgcctaaggtgc

SEQ ID NO: 1056 - DNA, 21 bp, Zea mays
gagggtgcgaatgttgcgcct

SEQ ID NO: 1057 - DNA, 21 bp, Zea mays
tgaaccaaacaggccctatat

SEQ ID NO: 1058 - DNA, 21 bp, Zea mays
cgtgcctgagccagagttgtg

SEQ ID NO: 1059 - DNA, 21 bp, Zea mays
agaggctgttcaccttggaga

SEQ ID NO: 1060 - DNA, 21 bp, Zea mays
tgcccgtgcgttgcaacgggg

SEQ ID NO: 1061 - DNA, 21 bp, Zea mays
gtggtcgcgggcgggtttggg

SEQ ID NO: 1062 - DNA, 21 bp, Zea mays
gagggtgcgaatgttgcggct

SEQ ID NO: 1063 - DNA, 21 bp, Zea mays
gtcctatggaaccaaacatat

SEQ ID NO: 1064 - DNA, 21 bp, Zea mays
agctcggcgccaagatctatg

SEQ ID NO: 1065 - DNA, 21 bp, Zea mays
tgcggctgcaatccggctgtg

SEQ ID NO: 1066 - DNA, 21 bp, Zea mays
caacgtacggacactcaccta

SEQ ID NO: 1067 - DNA, 21 bp, Zea mays
ggtgcaagcatgcaatcaaac

SEQ ID NO: 1068 - DNA, 21 bp, Zea mays
accgaccgaccgaccgacctg

SEQ ID NO: 1069 - DNA, 21 bp, Zea mays
cagtccacagaagcagccagg

SEQ ID NO: 1070 - DNA, 21 bp, Zea mays
actcggcggcgattgacttgg

SEQ ID NO: 1071 - DNA, 21 bp, Zea mays
gtagcaacgcacgggcatata

SEQ ID NO: 1072 - DNA, 21 bp, Zea mays
tttttgacactcggcaaaact

SEQ ID NO: 1073 - DNA, 21 bp, Zea mays
cagacgccacaccgcgccaca

SEQ ID NO: 1074 - DNA, 21 bp, Zea mays
gagccgagccgagctgagctg

SEQ ID NO: 1075 - DNA, 21 bp, Zea mays
gtcttcgcacggatcgaccgg

SEQ ID NO: 1076 - DNA, 21 bp, Zea mays
cccaaggcgtccagcaccgtg

SEQ ID NO: 1077 - DNA, 21 bp, Zea mays
ctccacgctctacagcggttc

SEQ ID NO: 1078 - DNA, 21 bp, Zea mays
acgctgacgtggcacgtgagt

SEQ ID NO: 1079 - DNA, 21 bp, Zea mays
ctgatttggtgaccaggaatc

SEQ ID NO: 1080 - DNA, 21 bp, Zea mays
tggctcccgctgcccgccggt

SEQ ID NO: 1081 - DNA, 21 bp, Zea mays
ggtgcaagcatgcaatcaatc

SEQ ID NO: 1082 - DNA, 21 bp, Zea mays
gggggtgtttggtttctagtt

SEQ ID NO: 1083 - DNA, 21 bp, Zea mays
acaaaccaaacaagccctatg

SEQ ID NO: 1084 - DNA, 21 bp, Zea mays
aggtgattttagcccctctaa

SEQ ID NO: 1085 - DNA, 21 bp, Zea mays
caatcccctccggttttctcg

SEQ ID NO: 1086 - DNA, 21 bp, Zea mays
aagggctgatttggtgacaaa

SEQ ID NO: 1087 - DNA, 21 bp, Zea mays
acacaaacgaacaaggcctca

SEQ ID NO: 1088 - DNA, 21 bp, Zea mays
gcttatgtccgacggtcctgt

SEQ ID NO: 1089 - DNA, 21 bp, Zea mays
gaggccgtcggaggtaagggg

SEQ ID NO: 1090 - DNA, 21 bp, Zea mays
attggatgcctgctgctcggc

SEQ ID NO: 1091 - DNA, 21 bp, Zea mays
gtggaggcaggaagacgagca

SEQ ID NO: 1092 - DNA, 21 bp, Zea mays
gttcttgggggccgattggcg

SEQ ID NO: 1093 - DNA, 21 bp, Zea mays
agcacggcccagcccgcgatt

SEQ ID NO: 1094 - DNA, 21 bp, Zea mays
aaagcacggcccgacacggct

SEQ ID NO: 1095 - DNA, 21 bp, Zea mays
ggtgcacggttctgcctatag

SEQ ID NO: 1096 - DNA, 21 bp, Zea mays
ttgctccggcacgaggacgta

SEQ ID NO: 1097 - DNA, 21 bp, Zea mays
accccatccgctctcgggttg

SEQ ID NO: 1098 - DNA, 21 bp, Zea mays
gaaccaaacaggcccatagtc

SEQ ID NO: 1099 - DNA, 21 bp, Zea mays
tgggcctgtttggttcgtgcc

SEQ ID NO: 1100 - DNA, 21 bp, Zea mays
cgatccggaggagacgaggcc

SEQ ID NO: 1101 - DNA, 21 bp, Zea mays
gcccgcccgcccgcccgaggc

SEQ ID NO: 1102 - DNA, 21 bp, Zea mays
tttgcaagggggatgctgccg

SEQ ID NO: 1103 - DNA, 21 bp, Zea mays
ggaacgattccgggtgcagtc

SEQ ID NO: 1104 - DNA, 21 bp, Zea mays
caaatcccaacagcaccaaga

SEQ ID NO: 1105 - DNA, 21 bp, Zea mays
agctcggctcggctcgctttg

SEQ ID NO: 1106 - DNA, 21 bp, Zea mays
tggctggctggctggctccgg

SEQ ID NO: 1107 - DNA, 21 bp, Zea mays
ggagctatcccaaacaggacc

SEQ ID NO: 1108 - DNA, 21 bp, Zea mays
gtgcgttcggttaagccctga

SEQ ID NO: 1109 - DNA, 21 bp, Zea mays
ctctttgccgagtgccagggc

SEQ ID NO: 1110 - DNA, 21 bp, Zea mays
tgcccgtgcgttgcaacggag

SEQ ID NO: 1111 - DNA, 21 bp, Zea mays
tcggcggcgaggtactcaagc

SEQ ID NO: 1112 - DNA, 21 bp, Zea mays
gctgcgatgctcgtgcaccga

SEQ ID NO: 1113 - DNA, 21 bp, Zea mays
ttgcaacgcacgggcactaac

SEQ ID NO: 1114 - DNA, 21 bp, Zea mays
cggagctaaggaacggtggct

SEQ ID NO: 1115 - DNA, 21 bp, Zea mays
cgtgccgtgccggcactatac

SEQ ID NO: 1116 - DNA, 21 bp, Zea mays
tgtgaggggctgcaaacagag

SEQ ID NO: 1117 - DNA, 21 bp, Zea mays
ttggttgcaatgacaggacgg

SEQ ID NO: 1118 - DNA, 21 bp, Zea mays
cgggtgaagcggccacatcga

SEQ ID NO: 1119 - DNA, 21 bp, Zea mays
caccccccccccccccccctt

SEQ ID NO: 1120 - DNA, 21 bp, Zea mays
gtccagtacggttgctccact

SEQ ID NO: 1121 - DNA, 21 bp, Zea mays
ggtaccgtcgaacttaatgtt

SEQ ID NO: 1122 - DNA, 21 bp, Zea mays
ggcactcggcaaagaagcatc

SEQ ID NO: 1123 - DNA, 21 bp, Zea mays
acagcactcggcaaagaattt

SEQ ID NO: 1124 - DNA, 21 bp, Zea mays
ggagctatcccaaacagggcc

SEQ ID NO: 1125 - DNA, 21 bp, Zea mays
ttggttgcaatgacaggacga

SEQ ID NO: 1126 - DNA, 21 bp, Zea mays
ttagccacgaaccaaacactg

SEQ ID NO: 1127 - DNA, 21 bp, Zea mays
caggaaccgccgaaaataggc

SEQ ID NO: 1128 - DNA, 21 bp, Zea mays
ggtcgcttggaggctaagtct

SEQ ID NO: 1129 - DNA, 21 bp, Zea mays
tgaaccaaacaggccctaaag

SEQ ID NO: 1130 - DNA, 21 bp, Zea mays
acacaaacgaacaaggccaga

SEQ ID NO: 1131 - DNA, 21 bp, Zea mays
aggctaatccaacagactctg

SEQ ID NO: 1132 - DNA, 21 bp, Zea mays
ccacccacccacccaccccca

SEQ ID NO: 1133 - DNA, 21 bp, Zea mays
tcggcaaagagccaaatttcg

SEQ ID NO: 1134 - DNA, 21 bp, Zea mays
aggcaggcaggcaggcacgct

SEQ ID NO: 1135 - DNA, 21 bp, Zea mays
ggaggggattggaggggctgg

SEQ ID NO: 1136 - DNA, 21 bp, Zea mays
caggccttgttcgtttgtgcc

SEQ ID NO: 1137 - DNA, 21 bp, Zea mays
agggctgatttggtgaccatg

SEQ ID NO: 1138 - DNA, 21 bp, Zea mays
gctgcatccacacgtacgtct

SEQ ID NO: 1139 - DNA, 21 bp, Zea mays
cgtgccgtgcttgggccgtgc

SEQ ID NO: 1140 - DNA, 21 bp, Zea mays
cctgtttggttcgtggctaat

SEQ ID NO: 1141 - DNA, 21 bp, Zea mays
agactgtcttcagcggttccc

SEQ ID NO: 1142 - DNA, 21 bp, Zea mays
gcggcagtgccctctcccacg

SEQ ID NO: 1143 - DNA, 21 bp, Zea mays
cgaacccctgccccacccata

SEQ ID NO: 1144 - DNA, 21 bp, Zea mays
cccatgtgagaacgaccacga

SEQ ID NO: 1145 - DNA, 21 bp, Zea mays
cgaaccgcctgtgatgtaaaa

SEQ ID NO: 1146 - DNA, 21 bp, Zea mays
catcacaggcggttcggttag

SEQ ID NO: 1147 - DNA, 21 bp, Zea mays
aggcggtgaccgaggaggcgc

SEQ ID NO: 1148 - DNA, 21 bp, Zea mays
aggtgagtgcccgtgcgtcac

SEQ ID NO: 1149 - DNA, 21 bp, Zea mays
gctaacaggctggcccgacac

SEQ ID NO: 1150 - DNA, 21 bp, Zea mays
ggcctacgggccgagcctaca

SEQ ID NO: 1151 - DNA, 21 bp, Zea mays
gcccgtgcgttgcgacgacac

SEQ ID NO: 1152 - DNA, 21 bp, Zea mays
aggctggctggctgcgtggcc

SEQ ID NO: 1153 - DNA, 21 bp, Zea mays
aaaaagcactcggcaaagaag

SEQ ID NO: 1154 - DNA, 21 bp, Zea mays
agggctgatttggtgacaaga

SEQ ID NO: 1155 - DNA, 21 bp, Zea mays
gcagacaacgacgacggcgtc

SEQ ID NO: 1156 - DNA, 21 bp, Zea mays
aacccagcctgagcacgacta

SEQ ID NO: 1157 - DNA, 21 bp, Zea mays
aagatccgatcagatatgtgt

SEQ ID NO: 1158 - DNA, 21 bp, Zea mays
aaaaagacagtggtagtatag

SEQ ID NO: 1159 - DNA, 21 bp, Zea mays
ctagttttgcaactctttttt

SEQ ID NO: 1160 - DNA, 21 bp, Zea mays
actctagtattgaagtggttt

SEQ ID NO: 1161 - DNA, 21 bp, Zea mays
aaaggtcaaactaattataaa

SEQ ID NO: 1162 - DNA, 21 bp, Zea mays
gtggacttcgcgcaggattta

SEQ ID NO: 1163 - DNA, 21 bp, Zea mays
ggatctggtttcgactaattt

SEQ ID NO: 1164 - DNA, 21 bp, Zea mays
gtcaggattcattccagctca

SEQ ID NO: 1165 - DNA, 21 bp, Zea mays
acctgtgatgtgtgactatca

SEQ ID NO: 1166 - DNA, 21 bp, Zea mays
ggaacgattcctaaccggatt

SEQ ID NO: 1167 - DNA, 21 bp, Zea mays
gttgtcggctggttgcgcccg

SEQ ID NO: 1168 - DNA, 21 bp, Zea mays
tttttggctcatgccctctag

SEQ ID NO: 1169 - DNA, 21 bp, Zea mays
cactccatattttgatctatc

SEQ ID NO: 1170 - DNA, 21 bp, Zea mays
gtccagcactgacttcgacac

SEQ ID NO: 1171 - DNA, 21 bp, Zea mays
gtggacttcgcgcaggatttg

SEQ ID NO: 1172 - DNA, 21 bp, Zea mays
gtggacttcgcgcaggatctg

SEQ ID NO: 1173 - DNA, 21 bp, Zea mays
aactttgcactatatatagag

SEQ ID NO: 1174 - DNA, 21 bp, Zea mays
tcggcaagtcatccttggctg

SEQ ID NO: 1175 - DNA, 21 bp, Zea mays
gctataggctatggcgtcgaa

SEQ ID NO: 1176 - DNA, 21 bp, Zea mays
ctaactactagttctagtgca

SEQ ID NO: 1177 - DNA, 21 bp, Zea mays
cactccatattttgatctata

SEQ ID NO: 1178 - DNA, 21 bp, Zea mays
ggagatattgacgcggctcaa

SEQ ID NO: 1179 - DNA, 21 bp, Zea mays
ttgagccgcgtcaatatctcc

SEQ ID NO: 1180 - DNA, 21 bp, Zea mays
gaactaaccttaggcacaaaa

SEQ ID NO: 1181 - DNA, 21 bp, Zea mays
gtttatgtcgctgatttgtcc

SEQ ID NO: 1182 - DNA, 21 bp, Zea mays
ccgctacatttggagggtaga

SEQ ID NO: 1183 - DNA, 21 bp, Zea mays
gtggacttcgcgcaggattgg

SEQ ID NO: 1184 - DNA, 21 bp, Zea mays
atcttcttgcgcctctactgc

SEQ ID NO: 1185 - DNA, 21 bp, Zea mays
aagatcacatcaatcccttgg

SEQ ID NO: 1186 - DNA, 21 bp, Zea mays
ttgttgtgcttagtccggctg

SEQ ID NO: 1187 - DNA, 21 bp, Zea mays
agctaagcctgcgcgtggtgc

SEQ ID NO: 1188 - DNA, 21 bp, Zea mays
acaattggtcatcgcgcttgg

SEQ ID NO: 1189 - DNA, 21 bp, Zea mays
tctcttgcccttctcggactg

SEQ ID NO: 1190 - DNA, 21 bp, Zea mays
gatatagggttgggcctctga

SEQ ID NO: 1191 - DNA, 21 bp, Zea mays
ggaaatagcattatgtccgac

SEQ ID NO: 1192 - DNA, 21 bp, Zea mays
gtggacgcctataccatagcc

SEQ ID NO: 1193 - DNA, 21 bp, Zea mays
gatatagggttgggcctctgg

SEQ ID NO: 1194 - DNA, 21 bp, Zea mays
acggtcctctaaatttagagg

SEQ ID NO: 1195 - DNA, 21 bp, Zea mays
ccgcattcgtgcgtgaggtgg

SEQ ID NO: 1196 - DNA, 21 bp, Zea mays
aaacggttctctatctatttg

SEQ ID NO: 1197 - DNA, 21 bp, Zea mays
gaatccttgccgtgttcgcgg

SEQ ID NO: 1198 - DNA, 21 bp, Zea mays
aaaagtcaaacgcttgatgtg

SEQ ID NO: 1199 - DNA, 21 bp, Zea mays
ggcatgtcgctcgcccagatg

SEQ ID NO: 1200 - DNA, 21 bp, Zea mays
ggcatgtcgctcgcccagatc

SEQ ID NO: 1201 - DNA, 21 bp, Zea mays
ggcatgtcgctcgcccagatt

SEQ ID NO: 1202 - DNA, 21 bp, Zea mays
cacgagcccggcacgaaataa

SEQ ID NO: 1203 - DNA, 21 bp, Zea mays
ccgatgctcggcgccataggc

SEQ ID NO: 1204 - DNA, 21 bp, Zea mays
cctaagtcacgcctcaggggc

SEQ ID NO: 1205 - DNA, 21 bp, Zea mays
atgttcctacactatgtagac

SEQ ID NO: 1206 - DNA, 21 bp, Zea mays
gtagttgatagccaaggtcgc

SEQ ID NO: 1207 - DNA, 21 bp, Zea mays
aaaggcactcggcaaagtata

SEQ ID NO: 1208 - DNA, 21 bp, Zea mays
gtaagccagcgggcggagtct

SEQ ID NO: 1209 - DNA, 21 bp, Zea mays
ctcggcaaagaacctaacatg

SEQ ID NO: 1210 - DNA, 21 bp, Zea mays
tgagcctgtaagcgctggggg

SEQ ID NO: 1211 - DNA, 21 bp, Zea mays
ccacatcggctgccacgtagg

SEQ ID NO: 1212 - DNA, 21 bp, Zea mays
cagtctttgccgagtgccaac

SEQ ID NO: 1213 - DNA, 21 bp, Zea mays
acagactttgccgagtgccaa

SEQ ID NO: 1214 - DNA, 21 bp, Zea mays
ttagctggaacgattccgagt

SEQ ID NO: 1215 - DNA, 21 bp, Zea mays
cgacgacgaagggcggttgcg

SEQ ID NO: 1216 - DNA, 21 bp, Zea mays
tagggctagtttgggagccac

SEQ ID NO: 1217 - DNA, 21 bp, Zea mays
tccagaccgggctgatccacg

SEQ ID NO: 1218 - DNA, 21 bp, Zea mays
gtcattgttgtcggtcctcct

SEQ ID NO: 1219 - DNA, 21 bp, Zea mays
tgatgctgcggtagtggtccc

SEQ ID NO: 1220 - DNA, 21 bp, Zea mays
tgggcgcagtcttcgccgtgg

SEQ ID NO: 1221 - DNA, 21 bp, Zea mays
aggccgaaacgtgctcgtgga

SEQ ID NO: 1222 - DNA, 21 bp, Zea mays
caagtgctcggcgaaaggcca

SEQ ID NO: 1223 - DNA, 21 bp, Zea mays
gttgttgttgcttcttcatat

SEQ ID NO: 1224 - DNA, 21 bp, Zea mays
aaaagacccatgttggtttgt

SEQ ID NO: 1225 - DNA, 21 bp, Zea mays
gtcgaagacctcatagtgact

SEQ ID NO: 1226 - DNA, 21 bp, Zea mays
gacattttggacctggtgcgt

SEQ ID NO: 1227 - DNA, 21 bp, Zea mays
gcggacggctggcgtgccgat

SEQ ID NO: 1228 - DNA, 21 bp, Zea mays
tttgccgagtgccgccgatct

SEQ ID NO: 1229 - DNA, 21 bp, Zea mays
agggagaccgaacgggttcaa

SEQ ID NO: 1230 - DNA, 21 bp, Zea mays
aggccttgttcgtttctgtca

SEQ ID NO: 1231 - DNA, 21 bp, Zea mays
agtccgacaaggccactaaca

SEQ ID NO: 1232 - DNA, 21 bp, Zea mays
ccttgtgcaggcaaccaaata

SEQ ID NO: 1233 - DNA, 21 bp, Zea mays
cccgtgcgttgcgacgggaat

SEQ ID NO: 1234 - DNA, 21 bp, Zea mays
acgtctttgccgagtgtctcc

SEQ ID NO: 1235 - DNA, 21 bp, Zea mays
gtcgaagacctcatagtgttt

SEQ ID NO: 1236 - DNA, 21 bp, Zea mays
aggccgaagcctatcagacag

SEQ ID NO: 1237 - DNA, 21 bp, Zea mays
aaaacactcggcaaagaaact

SEQ ID NO: 1238 - DNA, 21 bp, Zea mays
aaaacactcggcaaagactct

SEQ ID NO: 1239 - DNA, 21 bp, Zea mays
ttggtttgacttcgagactgc

SEQ ID NO: 1240 - DNA, 21 bp, Zea mays
acgacagccgtcggacataat

SEQ ID NO: 1241 - DNA, 21 bp, Zea mays
ccatagcactcggcaaagaac

SEQ ID NO: 1242 - DNA, 21 bp, Zea mays
agagtgaagcaggctatccaa

SEQ ID NO: 1243 - DNA, 21 bp, Zea mays
cccggtcgtactcataaccgc

SEQ ID NO: 1244 - DNA, 21 bp, Zea mays
cgacctctttgccgagtgcct

SEQ ID NO: 1245 - DNA, 21 bp, Zea mays
caagatctatggcgccgaggt

SEQ ID NO: 1246 - DNA, 21 bp, Zea mays
tcaagatctgtggcgccgagc

SEQ ID NO: 1247 - DNA, 21 bp, Zea mays
cagtctttgccgagtgccaga

SEQ ID NO: 1248 - DNA, 21 bp, Zea mays
agctcttgctgccgactgagt

SEQ ID NO: 1249 - DNA, 21 bp, Zea mays
tggagaccgtgctgtcatcga

SEQ ID NO: 1250 - DNA, 21 bp, Zea mays
ctggcactcgacaaagaagca

SEQ ID NO: 1251 - DNA, 21 bp, Zea mays
aagatgtgaccacgacttggt

SEQ ID NO: 1252 - DNA, 21 bp, Zea mays
acccagcgggtggtccattta

SEQ ID NO: 1253 - DNA, 21 bp, Zea mays
gacgaggagttcgcgaggcag

SEQ ID NO: 1254 - DNA, 21 bp, Zea mays
aaggcggcaatcgcctcggct

SEQ ID NO: 1255 - DNA, 21 bp, Zea mays
caaagactttgccgagtgcca

SEQ ID NO: 1256 - DNA, 21 bp, Zea mays
caagcccgaaaaggcccgtct

SEQ ID NO: 1257 - DNA, 21 bp, Zea mays
cacacttttcccgccgcagtt

SEQ ID NO: 1258 - DNA, 21 bp, Zea mays
caattcgaacgactaacctta

SEQ ID NO: 1259 - DNA, 21 bp, Zea mays
aggtgcgcgcagtggagatcg

SEQ ID NO: 1260 - DNA, 21 bp, Zea mays
gcattcatgtgcattattgca

SEQ ID NO: 1261 - DNA, 21 bp, Zea mays
aggcactcggcaaagaagtta

SEQ ID NO: 1262 - DNA, 21 bp, Zea mays
tctgggttgaacggcggagat

SEQ ID NO: 1263 - DNA, 21 bp, Zea mays
tgaacacgactgagtgcaggg

SEQ ID NO: 1264 - DNA, 21 bp, Zea mays
taggatgtgtttggttggatg

SEQ ID NO: 1265 - DNA, 21 bp, Zea mays
caaggtcgaggaccctgtggt

SEQ ID NO: 1266 - DNA, 21 bp, Zea mays
gtgtacgccgcagcacgggcg

SEQ ID NO: 1267 - DNA, 21 bp, Zea mays
ccatagcactcggcaaaaaag

SEQ ID NO: 1268 - DNA, 21 bp, Zea mays
gccatagcctatgacgctgag

SEQ ID NO: 1269 - DNA, 21 bp, Zea mays
tttctttgccgagtgcccgtg

SEQ ID NO: 1270 - DNA, 21 bp, Zea mays
aggctttgccgagtgtccagc

SEQ ID NO: 1271 - DNA, 21 bp, Zea mays
gagggtcggctctgataccat

SEQ ID NO: 1272 - DNA, 21 bp, Zea mays
tggtgttaagtgccggtgggc

SEQ ID NO: 1273 - DNA, 21 bp, Zea mays
taagcttatgtccgacggcta

SEQ ID NO: 1274 - DNA, 21 bp, Zea mays
cccgtgcgttgcaacgggacc

SEQ ID NO: 1275 - DNA, 21 bp, Zea mays
cacaaacgaacaagaccttat

SEQ ID NO: 1276 - DNA, 21 bp, Zea mays
tgggcccaataacttgggagg

SEQ ID NO: 1277 - DNA, 21 bp, Zea mays
atggatcggctggtcctggca

SEQ ID NO: 1278 - DNA, 21 bp, Zea mays
ccaagatctacggcgccaagg

SEQ ID NO: 1279 - DNA, 21 bp, Zea mays
gtgtaagcctgaatgacttgt

SEQ ID NO: 1280 - DNA, 21 bp, Zea mays
agaggccgttgtcgatgatcg

SEQ ID NO: 1281 - DNA, 21 bp, Zea mays
gtgtacccgccccacgaatct

SEQ ID NO: 1282 - DNA, 21 bp, Zea mays
cccgtgcgttgcgacggctta

SEQ ID NO: 1283 - DNA, 21 bp, Zea mays
actccctcgggatgactgcac

SEQ ID NO: 1284 - DNA, 21 bp, Zea mays
gtaagccagcgggcggagcct

SEQ ID NO: 1285 - DNA, 21 bp, Zea mays
aaaagactcgtgttggtctgt

SEQ ID NO: 1286 - DNA, 21 bp, Zea mays
ccctgaagcggctcagtgcca

SEQ ID NO: 1287 - DNA, 21 bp, Zea mays
cgtattaggaacgtgggtacc

SEQ ID NO: 1288 - DNA, 21 bp, Zea mays
cggccaaaccacggcgatctg

SEQ ID NO: 1289 - DNA, 21 bp, Zea mays
ttagctggaacgattccggga

SEQ ID NO: 1290 - DNA, 21 bp, Zea mays
cacaaacgaacaagacctaag

SEQ ID NO: 1291 - DNA, 21 bp, Zea mays
cttgctgagttgctcgatagg

SEQ ID NO: 1292 - DNA, 21 bp, Zea mays
aaataagctgtgccaaacagg

SEQ ID NO: 1293 - DNA, 21 bp, Zea mays
ccacatcggctgccacgtaag

SEQ ID NO: 1294 - DNA, 21 bp, Zea mays
gcacatctacaccagcagcac

SEQ ID NO: 1295 - DNA, 21 bp, Zea mays
taggatgtgtttggttgcagg

SEQ ID NO: 1296 - DNA, 21 bp, Zea mays
cataggctatggcgccgagca

SEQ ID NO: 1297 - DNA, 21 bp, Zea mays
aggctagtttggtgtgtggcc

SEQ ID NO: 1298 - DNA, 21 bp, Zea mays
actccctcgggatgactgagt

SEQ ID NO: 1299 - DNA, 21 bp, Zea mays
tggacaggaaaatggattcat

SEQ ID NO: 1300 - DNA, 21 bp, Zea mays
gtcgaagacctcatagtgccg

SEQ ID NO: 1301 - DNA, 21 bp, Zea mays
aaggccttgttcgtttgtatc

SEQ ID NO: 1302 - DNA, 21 bp, Zea mays
ctttgccgagtgtctgcacca

SEQ ID NO: 1303 - DNA, 21 bp, Zea mays
gtgacactcggcaaagagccc

SEQ ID NO: 1304 - DNA, 21 bp, Zea mays
gttggctagagggtggaaaag

SEQ ID NO: 1305 - DNA, 21 bp, Zea mays
ttcagtgactggcactacaga

SEQ ID NO: 1306 - DNA, 21 bp, Zea mays
aaaactttgttcccaaacacc

SEQ ID NO: 1307 - DNA, 21 bp, Zea mays
gacgggaattaaaataaagcc

SEQ ID NO: 1308 - DNA, 21 bp, Zea mays
ccgtggctagtctgcgctcgg

SEQ ID NO: 1309 - DNA, 21 bp, Zea mays
gaagccgccgaaaataaccta

SEQ ID NO: 1310 - DNA, 21 bp, Zea mays
gaagccgccgaaaataaccac

SEQ ID NO: 1311 - DNA, 21 bp, Zea mays
gtcatggatgagaggagagtg

SEQ ID NO: 1312 - DNA, 21 bp, Zea mays
gtctcagacacacggcaaaga

SEQ ID NO: 1313 - DNA, 21 bp, Zea mays
gtctgagacacacggcaaagg

SEQ ID NO: 1314 - DNA, 21 bp, Zea mays
ttctttgccgagtgccatttg

SEQ ID NO: 1315 - DNA, 21 bp, Zea mays
agatcttggcggcgaacatcc

SEQ ID NO: 1316 - DNA, 21 bp, Zea mays
gttaggaacgtgggtacccat

SEQ ID NO: 1317 - DNA, 21 bp, Zea mays
acatgtcggggctcagcattc

SEQ ID NO: 1318 - DNA, 21 bp, Zea mays
aaactttggttgagaccaatt

SEQ ID NO: 1319 - DNA, 21 bp, Zea mays
ttatgtccgacggctttggtc

SEQ ID NO: 1320 - DNA, 21 bp, Zea mays
gccacactttgtctaagctta

SEQ ID NO: 1321 - DNA, 21 bp, Zea mays
ggcaaagtgtggcaagtgagg

SEQ ID NO: 1322 - DNA, 21 bp, Zea mays
cggccaaaccacggcgatggg

SEQ ID NO: 1323 - DNA, 21 bp, Zea mays
aaaggcactcggcaaagtatt

SEQ ID NO: 1324 - DNA, 21 bp, Zea mays
aaaagcactcgacaaagaaaa

SEQ ID NO: 1325 - DNA, 21 bp, Zea mays
cacaaacgaacaagacctttt

SEQ ID NO: 1326 - DNA, 21 bp, Zea mays
agaccttacttaaggcccagg

SEQ ID NO: 1327 - DNA, 21 bp, Zea mays
tagggctagtttgggagtcac

SEQ ID NO: 1328 - DNA, 21 bp, Zea mays
gaagatcgggcatcgtgacgc

SEQ ID NO: 1329 - DNA, 21 bp, Zea mays
gttcgtttctgctggaacaga

SEQ ID NO: 1330 - DNA, 21 bp, Zea mays
gtccggttagtatagtgccag

SEQ ID NO: 1331 - DNA, 21 bp, Zea mays
ccgagtgtcggcgaaatgcaa

SEQ ID NO: 1332 - DNA, 21 bp, Zea mays
cctcgaggatgctgacgcaat

SEQ ID NO: 1333 - DNA, 21 bp, Zea mays
ctgggccaattgcgtctttgc

SEQ ID NO: 1334 - DNA, 21 bp, Zea mays
cagccgcagtcggattaggac

SEQ ID NO: 1335 - DNA, 21 bp, Zea mays
acgagtcttttgtgcgcactt

SEQ ID NO: 1336 - DNA, 21 bp, Zea mays
gtctccgccatctagcgacgt

SEQ ID NO: 1337 - DNA, 21 bp, Zea mays
tcaaccagatcgcgccccgct

SEQ ID NO: 1338 - DNA, 21 bp, Zea mays
aagactgcgcagaagtcaaac

SEQ ID NO: 1339 - DNA, 21 bp, Zea mays
aaacgaacaaggcctaagatg

SEQ ID NO: 1340 - DNA, 21 bp, Zea mays
taggccctgtttggaagcacc

SEQ ID NO: 1341 - DNA, 21 bp, Zea mays
cactcggcaaagaacgcgatt

SEQ ID NO: 1342 - DNA, 21 bp, Zea mays
agccttctttgccgagtactt

SEQ ID NO: 1343 - DNA, 21 bp, Zea mays
tcactctcttctgtcagcttt

SEQ ID NO: 1344 - DNA, 21 bp, Zea mays
ctttgccgagtgtttttttcg

SEQ ID NO: 1345 - DNA, 21 bp, Zea mays
ttttcagcttcggctctggct

SEQ ID NO: 1346 - DNA, 21 bp, Zea mays
atgcggcggactgtgctcgtt

SEQ ID NO: 1347 - DNA, 21 bp, Zea mays
agcacggcactaagcctgctt

SEQ ID NO: 1348 - DNA, 21 bp, Zea mays
tgagcctgtaagcgctggtgg

SEQ ID NO: 1349 - DNA, 21 bp, Zea mays
tggaccgaaggcgtggcacga

SEQ ID NO: 1350 - DNA, 21 bp, Zea mays
cggccaaaccacggcgaccta

SEQ ID NO: 1351 - DNA, 21 bp, Zea mays
cgtgggtacccacgttcttat

SEQ ID NO: 1352 - DNA, 21 bp, Zea mays
cggccaaaccacggcgatcta

SEQ ID NO: 1353 - DNA, 21 bp, Zea mays
gcgtcgtcctcctggtgtggc

SEQ ID NO: 1354 - DNA, 21 bp, Zea mays
ctttgccgagtgccagccgtt

SEQ ID NO: 1355 - DNA, 21 bp, Zea mays
gctaacttcctagagacggcc

SEQ ID NO: 1356 - DNA, 21 bp, Zea mays
ccatagcactcggcaaagaaa

SEQ ID NO: 1357 - DNA, 21 bp, Zea mays
ccatagcactcggcaaagaag

SEQ ID NO: 1358 - DNA, 21 bp, Zea mays
caagcaagattggtcggatta

SEQ ID NO: 1359 - DNA, 21 bp, Zea mays
gtgagtgtccgtgcgttacag

SEQ ID NO: 1360 - DNA, 21 bp, Zea mays
atctagatctaaccgaccaag

SEQ ID NO: 1361 - DNA, 21 bp, Zea mays
agatcttggcgccgagctgcg

SEQ ID NO: 1362 - DNA, 21 bp, Zea mays
tggcactcggcaaagaagcaa

SEQ ID NO: 1363 - DNA, 21 bp, Zea mays
tgcgaaggccctgacgctgtg

SEQ ID NO: 1364 - DNA, 21 bp, Zea mays
gccgagatgccagcctaagga

SEQ ID NO: 1365 - DNA, 21 bp, Zea mays
catcctgcagacggcgtgcat

SEQ ID NO: 1366 - DNA, 21 bp, Zea mays
ccctgaagcggctcagtgaca

SEQ ID NO: 1367 - DNA, 21 bp, Zea mays
gcttctttgccgagtgtggtg

SEQ ID NO: 1368 - DNA, 21 bp, Zea mays
aagcccggcacggctattgga

SEQ ID NO: 1369 - DNA, 21 bp, Zea mays
atggcctgtttggttcgtggc

SEQ ID NO: 1370 - DNA, 21 bp, Zea mays
gacgacgacgacgatgacgat

SEQ ID NO: 1371 - DNA, 21 bp, Zea mays
cagagcaggctcaatggacaa

SEQ ID NO: 1372 - DNA, 21 bp, Zea mays
agagcaggctcggatgagtga

SEQ ID NO: 1373 - DNA, 21 bp, Zea mays
agcctttgccgagtgtcagtt

SEQ ID NO: 1374 - DNA, 21 bp, Zea mays
ttagctggaacgattccggat

SEQ ID NO: 1375 - DNA, 21 bp, Zea mays
ttctttgccgagtgccagata

SEQ ID NO: 1376 - DNA, 21 bp, Zea mays
tggcactcggcaaagaagctc

SEQ ID NO: 1377 - DNA, 21 bp, Zea mays
ttctttgccgagtgccaaagc

SEQ ID NO: 1378 - DNA, 21 bp, Zea mays
gaagactggtgcacatgatgc

SEQ ID NO: 1379 - DNA, 21 bp, Zea mays
tgatgctgcggtagtggtctc

SEQ ID NO: 1380 - DNA, 21 bp, Zea mays
gagttcagcgaaggggacctc

SEQ ID NO: 1381 - DNA, 21 bp, Zea mays
gacacaaacgaacaaggcctg

SEQ ID NO: 1382 - DNA, 21 bp, Zea mays
agccagggatgatttgcctgt

SEQ ID NO: 1383 - DNA, 21 bp, Zea mays
gcaacccagggtgtttgaagc

SEQ ID NO: 1384 - DNA, 21 bp, Zea mays
aggtgagtgaccgtgcgttgc

SEQ ID NO: 1385 - DNA, 21 bp, Zea mays
ccaagatctacggcgccgagg

SEQ ID NO: 1386 - DNA, 21 bp, Zea mays
ttctttgccgagtgccaacgt

SEQ ID NO: 1387 - DNA, 21 bp, Zea mays
tgaggcgaaggcaagcttgca

SEQ ID NO: 1388 - DNA, 21 bp, Zea mays
acttcgccagtgcttatcagc

SEQ ID NO: 1389 - DNA, 21 bp, Zea mays
gaactaagtcgcagcgaggtc

SEQ ID NO: 1390 - DNA, 21 bp, Zea mays
ccatagatcttggcgccgagg

SEQ ID NO: 1391 - DNA, 21 bp, Zea mays
aaagactttgccgagtgctga

SEQ ID NO: 1392 - DNA, 21 bp, Zea mays
tggaagccatcggatgccgga

SEQ ID NO: 1393 - DNA, 21 bp, Zea mays
agccggatgtgcttgctccgt

SEQ ID NO: 1394 - DNA, 21 bp, Zea mays
agcctttgccgagtgtcacct

SEQ ID NO: 1395 - DNA, 21 bp, Zea mays
cgcatgacgaccgttgaaaac

SEQ ID NO: 1396 - DNA, 21 bp, Zea mays
accggcggtgagattgctccg

SEQ ID NO: 1397 - DNA, 21 bp, Zea mays
acagctggtatcggagcaaat

SEQ ID NO: 1398 - DNA, 21 bp, Zea mays
gtcgaagacctcatagtgtcg

SEQ ID NO: 1399 - DNA, 21 bp, Zea mays
aaacacgactgagtgcagggc

SEQ ID NO: 1400 - DNA, 21 bp, Zea mays
aagagacctacttgcacgatt

SEQ ID NO: 1401 - DNA, 21 bp, Zea mays
gtgtaagcgatagcggcgagg

SEQ ID NO: 1402 - DNA, 21 bp, Zea mays
gctaacttcctagaggcaacc

SEQ ID NO: 1403 - DNA, 21 bp, Zea mays
agagcaggctcggatgagcaa

SEQ ID NO: 1404 - DNA, 21 bp, Zea mays
ggcgagacggactgggcagag

SEQ ID NO: 1405 - DNA, 21 bp, Zea mays
ttggcgaagtcctgcgtagat

SEQ ID NO: 1406 - DNA, 21 bp, Zea mays
gagtgtctgctggactaacgc

SEQ ID NO: 1407 - DNA, 21 bp, Zea mays
atgtccgacggcccgccacct

SEQ ID NO: 1408 - DNA, 21 bp, Zea mays
gttcttggccctatccacatg

SEQ ID NO: 1409 - DNA, 21 bp, Zea mays
agcctttgccgagtgtccact

SEQ ID NO: 1410 - DNA, 21 bp, Zea mays
gcattcatgtgcattatgcaa

SEQ ID NO: 1411 - DNA, 21 bp, Zea mays
ggcgaggttgacgacgagata

SEQ ID NO: 1412 - DNA, 21 bp, Zea mays
caatcaggagcattttgggtg

SEQ ID NO: 1413 - DNA, 21 bp, Zea mays
gacggagacagcgtcttcgcc

SEQ ID NO: 1414 - DNA, 21 bp, Zea mays
cggctttttgccgagtgttaa

SEQ ID NO: 1415 - DNA, 21 bp, Zea mays
gtgagaggctgcaaacatttt

SEQ ID NO: 1416 - DNA, 21 bp, Zea mays
aaacactgtgttgtgggtcca

SEQ ID NO: 1417 - DNA, 21 bp, Zea mays
cgaccaaaaaatactcgggcc

SEQ ID NO: 1418 - DNA, 21 bp, Zea mays
cgacgactttggccgtcgaag

SEQ ID NO: 1419 - DNA, 21 bp, Zea mays
attaggagcgtgggtacccac

SEQ ID NO: 1420 - DNA, 21 bp, Zea mays
tctgctggtgtgagatggtca

SEQ ID NO: 1421 - DNA, 21 bp, Zea mays
ccgacgcaaacgaacaagacc

SEQ ID NO: 1422 - DNA, 21 bp, Zea mays
cgtgcgttgcaacggaaccat

SEQ ID NO: 1423 - DNA, 21 bp, Zea mays
ccgaattccgtccacgcccgg

SEQ ID NO: 1424 - DNA, 21 bp, Zea mays
gtgtaagcctgaatgaccttc

SEQ ID NO: 1425 - DNA, 21 bp, Zea mays
agccttctttgccgagtgcca

SEQ ID NO: 1426 - DNA, 21 bp, Zea mays
gctggctccgtcttcacttga

SEQ ID NO: 1427 - DNA, 21 bp, Zea mays
actggacatgtttggtgccgc

SEQ ID NO: 1428 - DNA, 21 bp, Zea mays
gtttggtttgtggctaaatat

SEQ ID NO: 1429 - DNA, 21 bp, Zea mays
ccgacgcaaacgaacaatgcc

SEQ ID NO: 1430 - DNA, 21 bp, Zea mays
tgaacccatgatgcaccacct

SEQ ID NO: 1431 - DNA, 21 bp, Zea mays
tagggctagtttgggagccag

SEQ ID NO: 1432 - DNA, 21 bp, Zea mays
aagcactcggcaaagaaggca

SEQ ID NO: 1433 - DNA, 21 bp, Zea mays
gcttctttgccgagtgtcaag

SEQ ID NO: 1434 - DNA, 21 bp, Zea mays
aaacaggaccttgggtcttag

SEQ ID NO: 1435 - DNA, 21 bp, Zea mays
atgtgcccgtgcgttgctacg

SEQ ID NO: 1436 - DNA, 21 bp, Zea mays
ttatgtccgacggctttgtcc

SEQ ID NO: 1437 - DNA, 21 bp, Zea mays
gtttcggcctaggtcttagct

SEQ ID NO: 1438 - DNA, 21 bp, Zea mays
aaacctaaacacacgacgtgg

SEQ ID NO: 1439 - DNA, 21 bp, Zea mays
cgacctctttgccgagtgtcc

SEQ ID NO: 1440 - DNA, 21 bp, Zea mays
aaaaccggttgaaccgcccct

SEQ ID NO: 1441 - DNA, 21 bp, Zea mays
tcacaaaaatgaggataggcc

SEQ ID NO: 1442 - DNA, 21 bp, Zea mays
gacgccgaggtaacacatagt

SEQ ID NO: 1443 - DNA, 21 bp, Zea mays
agagcaggctcggatgagtgt

SEQ ID NO: 1444 - DNA, 21 bp, Zea mays
gtagtgcttctgagtagagtc

SEQ ID NO: 1445 - DNA, 21 bp, Zea mays
ctgcggctactgtgtccggtg

SEQ ID NO: 1446 - DNA, 21 bp, Zea mays
ggcgacgacttcgtacggcga

SEQ ID NO: 1447 - DNA, 21 bp, Zea mays
agctgccaggagtaagtatca

SEQ ID NO: 1448 - DNA, 21 bp, Zea mays
gtcatggatgagaggagagag

SEQ ID NO: 1449 - DNA, 21 bp, Zea mays
tcagtgactggtactgcacgg

SEQ ID NO: 1450 - DNA, 21 bp, Zea mays
gcagcccactacggtgtagta

SEQ ID NO: 1451 - DNA, 21 bp, Zea mays
ggctcgaccggattgcaccgt

SEQ ID NO: 1452 - DNA, 21 bp, Zea mays
tgatgctgcggtagtggtcac

SEQ ID NO: 1453 - DNA, 21 bp, Zea mays
aaaagcactcggcaaagatct

SEQ ID NO: 1454 - DNA, 21 bp, Zea mays
aggccttgttcgtttgtgttg

SEQ ID NO: 1455 - DNA, 21 bp, Zea mays
gagggtgacttggccagacat

SEQ ID NO: 1456 - DNA, 21 bp, Zea mays
gccgactactcctacaaattg

SEQ ID NO: 1457 - DNA, 21 bp, Zea mays
acagctggtatcggagcttgt

SEQ ID NO: 1458 - DNA, 21 bp, Zea mays
gagcttgactctagtccgact

SEQ ID NO: 1459 - DNA, 21 bp, Zea mays
tacgaccgatttcaggagcgg

SEQ ID NO: 1460 - DNA, 21 bp, Zea mays
agagcaggctcggatgagaga

SEQ ID NO: 1461 - DNA, 21 bp, Zea mays
tcgaggacgagctgcttgtcc

SEQ ID NO: 1462 - DNA, 21 bp, Zea mays
ctctgcagatctcccgaagac

SEQ ID NO: 1463 - DNA, 21 bp, Zea mays
tagcgacgttgctttttgatt

SEQ ID NO: 1464 - DNA, 21 bp, Zea mays
cttgactctagcgtccgaggc

SEQ ID NO: 1465 - DNA, 21 bp, Zea mays
acttcgccgagtgtttttcag

SEQ ID NO: 1466 - DNA, 21 bp, Zea mays
cagctgacaccgaatgccata

SEQ ID NO: 1467 - DNA, 21 bp, Zea mays
ctttgccgagtgtctgcgatc

SEQ ID NO: 1468 - DNA, 21 bp, Zea mays
ctttgccgagtgccagctgga

SEQ ID NO: 1469 - DNA, 21 bp, Zea mays
ctttgccgagtgccagcaggg

SEQ ID NO: 1470 - DNA, 21 bp, Zea mays
ggcggtctggcgaagtgagac

SEQ ID NO: 1471 - DNA, 21 bp, Zea mays
ccctacctggcgcgccaaatg

SEQ ID NO: 1472 - DNA, 21 bp, Zea mays
tagtcggttgtccgtgcgttg

SEQ ID NO: 1473 - DNA, 21 bp, Zea mays
gaaacgaacaaggcctaagca

SEQ ID NO: 1474 - DNA, 21 bp, Zea mays
atcaggctgcgttggtaatca

SEQ ID NO: 1475 - DNA, 21 bp, Zea mays
ttctcgaacacgcaggagagt

SEQ ID NO: 1476 - DNA, 21 bp, Zea mays
agcaagtctgcgaggcgtggc

SEQ ID NO: 1477 - DNA, 21 bp, Zea mays
gatgcattttgcgcatgggag

SEQ ID NO: 1478 - DNA, 21 bp, Zea mays
ggcgacgacttcgtacggcgg

SEQ ID NO: 1479 - DNA, 21 bp, Zea mays
cccgtgcgttgcaacggagac

SEQ ID NO: 1480 - DNA, 21 bp, Zea mays
cgctgtggacttcgcgcagga

SEQ ID NO: 1481 - DNA, 21 bp, Zea mays
caagcccgaaaaggcccgtat

SEQ ID NO: 1482 - DNA, 21 bp, Zea mays
ctgtgccaaacagggcctacg

SEQ ID NO: 1483 - DNA, 21 bp, Zea mays
tctcgagacttcggatggacg

SEQ ID NO: 1484 - DNA, 21 bp, Zea mays
ctccgcgatacggctgatcag

SEQ ID NO: 1485 - DNA, 21 bp, Zea mays
gggtgttacgctccggcggcc

SEQ ID NO: 1486 - DNA, 21 bp, Zea mays
ggtttgaccctcaagtgacga

SEQ ID NO: 1487 - DNA, 21 bp, Zea mays
agggcctgattggttgccgta

SEQ ID NO: 1488 - DNA, 21 bp, Zea mays
atgtgaccgttgatggacgtg

SEQ ID NO: 1489 - DNA, 21 bp, Zea mays
cttcagttgtggcaaggcgga

SEQ ID NO: 1490 - DNA, 21 bp, Zea mays
ccatagcactcggcaaaggat

SEQ ID NO: 1491 - DNA, 21 bp, Zea mays
tcggcaggaactgttgtcttt

SEQ ID NO: 1492 - DNA, 21 bp, Zea mays
tgggcgcagtcttcgccgtga

SEQ ID NO: 1493 - DNA, 21 bp, Zea mays
ctgcgcagaagtcaaacaacc

SEQ ID NO: 1494 - DNA, 21 bp, Zea mays
gcttctttgccgagtgtcaaa

SEQ ID NO: 1495 - DNA, 21 bp, Zea mays
tttcggtgacgcacttaagca

SEQ ID NO: 1496 - DNA, 21 bp, Zea mays
tagggctagtttgggagcccc

SEQ ID NO: 1497 - DNA, 21 bp, Zea mays
aaaacgtctatggatgcagat

SEQ ID NO: 1498 - DNA, 21 bp, Zea mays
cagtctttgccgagtgcccat

SEQ ID NO: 1499 - DNA, 21 bp, Zea mays
tttctttgccgagtgccacca

SEQ ID NO: 1500 - DNA, 21 bp, Zea mays
tcgcgagctaaacgagctatc

SEQ ID NO: 1501 - DNA, 21 bp, Zea mays
tggcgcctgagaatccatggt

SEQ ID NO: 1502 - DNA, 21 bp, Zea mays
gctgatttggtgaccagaaaa

SEQ ID NO: 1503 - DNA, 21 bp, Zea mays
gtgacactcggcaaagacgcc

SEQ ID NO: 1504 - DNA, 21 bp, Zea mays
ccattgcgacggcgcatggtg

SEQ ID NO: 1505 - DNA, 21 bp, Zea mays
ggcaaagactttgccgagtgc

SEQ ID NO: 1506 - DNA, 21 bp, Zea mays
cgtgctaaacgggccgtgccc

SEQ ID NO: 1507 - DNA, 21 bp, Zea mays
tccaacggagcagctaaatgg

SEQ ID NO: 1508 - DNA, 21 bp, Zea mays
aaccgcttgtgatgtgtggct

SEQ ID NO: 1509 - DNA, 21 bp, Zea mays
accaaaacgaccggatgtgag

SEQ ID NO: 1510 - DNA, 21 bp, Zea mays
tccgttgtagtctagctagtt

SEQ ID NO: 1511 - DNA, 21 bp, Zea mays
caagtgctcggcgaaaggcta

SEQ ID NO: 1512 - DNA, 21 bp, Zea mays
ctccccgctcaggcggaggcc

SEQ ID NO: 1513 - DNA, 21 bp, Zea mays
cccgtgcgttgcaacgagaac

SEQ ID NO: 1514 - DNA, 21 bp, Zea mays
ctgggccaagcccattccagc

SEQ ID NO: 1515 - DNA, 21 bp, Zea mays
attgcaaccatcagtattatg

SEQ ID NO: 1516 - DNA, 21 bp, Zea mays
cgtgcgttgctacggagttaa

SEQ ID NO: 1517 - DNA, 21 bp, Zea mays
gcgagcgtagttcagtggtaa

SEQ ID NO: 1518 - DNA, 21 bp, Zea mays
tgcttatgggaagggagacgg

SEQ ID NO: 1519 - DNA, 21 bp, Zea mays
ccgaaccgaaccgaagaaccg

SEQ ID NO: 1520 - DNA, 21 bp, Zea mays
gattaccaaacacagaacata

SEQ ID NO: 1521 - DNA, 21 bp, Zea mays
aagggtgcgtttggttgtgga

SEQ ID NO: 1522 - DNA, 21 bp, Zea mays
ctgaattaagtccgacggctc

SEQ ID NO: 1523 - DNA, 21 bp, Zea mays
cgacgagaggaaggaggacgc

SEQ ID NO: 1524 - DNA, 21 bp, Zea mays
actccctcgggatgactgtgt

SEQ ID NO: 1525 - DNA, 21 bp, Zea mays
ttctttgccgagtgccacggt

SEQ ID NO: 1526 - DNA, 21 bp, Zea mays
gctaacttcctagaggcgacc

SEQ ID NO: 1527 - DNA, 21 bp, Zea mays
cgccgcgccgggccgccacga

SEQ ID NO: 1528 - DNA, 21 bp, Zea mays
acagcctatggcgccgagctg

SEQ ID NO: 1529 - DNA, 21 bp, Zea mays
caaagacctcagacagctatg

SEQ ID NO: 1530 - DNA, 21 bp, Zea mays
gtacattcgggccgcccggtc

SEQ ID NO: 1531 - DNA, 21 bp, Zea mays
aaaagcactcggcaaagaaaa

SEQ ID NO: 1532 - DNA, 21 bp, Zea mays
ggtggtgtgtgcctgatgact

SEQ ID NO: 1533 - DNA, 21 bp, Zea mays
ccagtgacgggaagacactgt

SEQ ID NO: 1534 - DNA, 21 bp, Zea mays
gatggacggccaagtcactct

SEQ ID NO: 1535 - DNA, 21 bp, Zea mays
cactcgacaaagaaggctcca

SEQ ID NO: 1536 - DNA, 21 bp, Zea mays
tgcgctaacagacgtggagca

SEQ ID NO: 1537 - DNA, 21 bp, Zea mays
ttatgtccgacggctttggcc

SEQ ID NO: 1538 - DNA, 21 bp, Zea mays
ggccactgcacgacggcagtc

SEQ ID NO: 1539 - DNA, 21 bp, Zea mays
aaaagcactcggcaaagccac

SEQ ID NO: 1540 - DNA, 21 bp, Zea mays
gggtacagaaccctttagggt

SEQ ID NO: 1541 - DNA, 21 bp, Zea mays
agaggaccgtttagaggacgc

SEQ ID NO: 1542 - DNA, 21 bp, Zea mays
gtgttttgcggagacggatgc

SEQ ID NO: 1543 - DNA, 21 bp, Zea mays
aggatcccgcttgtgctcttg

SEQ ID NO: 1544 - DNA, 21 bp, Zea mays
acactcggcaaagactttgct

SEQ ID NO: 1545 - DNA, 21 bp, Zea mays
aaaacactcggcaaagagttt

SEQ ID NO: 1546 - DNA, 21 bp, Zea mays
ctgcgcagaagtcaaacagcc

SEQ ID NO: 1547 - DNA, 21 bp, Zea mays
gccataggctatggcgccgaa

SEQ ID NO: 1548 - DNA, 21 bp, Zea mays
gttggagcggggtgttttgtt

SEQ ID NO: 1549 - DNA, 21 bp, Zea mays
catagcctatggcgccgagct

SEQ ID NO: 1550 - DNA, 21 bp, Zea mays
ataggctatggcgccgagctt

SEQ ID NO: 1551 - DNA, 21 bp, Zea mays
cctagctcggcgccaagatct

SEQ ID NO: 1552 - DNA, 21 bp, Zea mays
aaggctttgccgagtgtgaca

SEQ ID NO: 1553 - DNA, 21 bp, Zea mays
gtgactgtgagagcgggatgg

SEQ ID NO: 1554 - DNA, 21 bp, Zea mays
accacattcgtttctgccctc

SEQ ID NO: 1555 - DNA, 21 bp, Zea mays
aaggctttgccgagtgtattc

SEQ ID NO: 1556 - DNA, 21 bp, Zea mays
ataggctatgacgccgagcaa

SEQ ID NO: 1557 - DNA, 21 bp, Zea mays
gtagagatggcaatggggatt

SEQ ID NO: 1558 - DNA, 21 bp, Zea mays
attagcgggctggtgctggca

SEQ ID NO: 1559 - DNA, 21 bp, Zea mays
atcgctgcgacccgcatcggc

SEQ ID NO: 1560 - DNA, 21 bp, Zea mays
gcactcgacaaagaaagcaca

SEQ ID NO: 1561 - DNA, 21 bp, Zea mays
gttgctgtgagccaggctcta

SEQ ID NO: 1562 - DNA, 21 bp, Zea mays
cttgcaggtagaagccatccg

SEQ ID NO: 1563 - DNA, 21 bp, Zea mays
cttccgacgggacccgtctta

SEQ ID NO: 1564 - DNA, 21 bp, Zea mays
gctgaatattggctgcgccct

SEQ ID NO: 1565 - DNA, 21 bp, Zea mays
gtccgacggctagactgacca

SEQ ID NO: 1566 - DNA, 21 bp, Zea mays
cacgagtcgagcgagctcacc

SEQ ID NO: 1567 - DNA, 21 bp, Zea mays
tgggccgtgcccgtccggcgg

SEQ ID NO: 1568 - DNA, 21 bp, Zea mays
agtgtgacacagttagccacg

SEQ ID NO: 1569 - DNA, 21 bp, Zea mays
agtcttttgtgcgcactttgt

SEQ ID NO: 1570 - DNA, 21 bp, Zea mays
caagagccaagaacgtcgtgc

SEQ ID NO: 1571 - DNA, 21 bp, Zea mays
cgcacttgttgtgctaagtcc

SEQ ID NO: 1572 - DNA, 21 bp, Zea mays
gagagccacaaaaccggagag

SEQ ID NO: 1573 - DNA, 21 bp, Zea mays
aagacgaagctagcagcgcga

SEQ ID NO: 1574 - DNA, 21 bp, Zea mays
tggcactcggcaaagaaactt

SEQ ID NO: 1575 - DNA, 21 bp, Zea mays
gcagatccgaagacggggtgt

SEQ ID NO: 1576 - DNA, 21 bp, Zea mays
agcggtccttctatgcaaacg

SEQ ID NO: 1577 - DNA, 21 bp, Zea mays
cccaagaatcaggtgaagaca

SEQ ID NO: 1578 - DNA, 21 bp, Zea mays
gcgaaggttgtcgacgttcca

SEQ ID NO: 1579 - DNA, 21 bp, Zea mays
ccccccccccccccccccatc

SEQ ID NO: 1580 - DNA, 21 bp, Zea mays
aagactggagcatgggagcag

SEQ ID NO: 1581 - DNA, 21 bp, Zea mays
gcgggtttgggtgtgagttta

SEQ ID NO: 1582 - DNA, 21 bp, Zea mays
gggcctgtttggtttgtggcg

SEQ ID NO: 1583 - DNA, 21 bp, Zea mays
tcactcgtcccgcaaccgttc

SEQ ID NO: 1584 - DNA, 21 bp, Zea mays
accgctgcggctataggtcgg

SEQ ID NO: 1585 - DNA, 21 bp, Zea mays
ctaaacactgtgctatgagtc

SEQ ID NO: 1586 - DNA, 21 bp, Zea mays
cacagatcttggtgccgagct

SEQ ID NO: 1587 - DNA, 21 bp, Zea mays
ccatagatcttggcgccgggc

SEQ ID NO: 1588 - DNA, 21 bp, Zea mays
ttctttgccgagtgccagctg

SEQ ID NO: 1589 - DNA, 21 bp, Zea mays
ctttgccgagtgccagcgtgc

SEQ ID NO: 1590 - DNA, 21 bp, Zea mays
ctgctctgaccggcggcgcac

SEQ ID NO: 1591 - DNA, 21 bp, Zea mays
acgcgatcgaacacgtggaag

SEQ ID NO: 1592 - DNA, 21 bp, Zea mays
agatcttggcgccgagctcgg

SEQ ID NO: 1593 - DNA, 21 bp, Zea mays
actggtttattgggctgcaaa

SEQ ID NO: 1594 - DNA, 21 bp, Zea mays
agcctcggcccatagtgctga

SEQ ID NO: 1595 - DNA, 21 bp, Zea mays
gagggctgtaaacatcgtggt

SEQ ID NO: 1596 - DNA, 21 bp, Zea mays
ctggaccgtgctttttttccg

SEQ ID NO: 1597 - DNA, 21 bp, Zea mays
cgtgcgttgctacggagtcag

SEQ ID NO: 1598 - DNA, 21 bp, Zea mays
catagtctatggcgccgagca

SEQ ID NO: 1599 - DNA, 21 bp, Zea mays
gggctaacacggcacgttaga

SEQ ID NO: 1600 - DNA, 21 bp, Zea mays
ttctttgccgagtgccaaaaa

SEQ ID NO: 1601 - DNA, 21 bp, Zea mays
acaggctatggcgccgagcta

SEQ ID NO: 1602 - DNA, 21 bp, Zea mays
atgcgggtcgcagcgatggcg

SEQ ID NO: 1603 - DNA, 21 bp, Zea mays
gcagtgaccgcacttataccc

SEQ ID NO: 1604 - DNA, 21 bp, Zea mays
acgtggggcagcaggctgctg

SEQ ID NO: 1605 - DNA, 21 bp, Zea mays
taggccctgtttggaagcgga

SEQ ID NO: 1606 - DNA, 21 bp, Zea mays
tttctttgccgagtgcccgat

SEQ ID NO: 1607 - DNA, 21 bp, Zea mays
cggcaaagcctttgtcgagcg

SEQ ID NO: 1608 - DNA, 21 bp, Zea mays
ttttgtggctcgtgtgctagg

SEQ ID NO: 1609 - DNA, 21 bp, Zea mays
acactcggcaaagactttgtc

SEQ ID NO: 1610 - DNA, 21 bp, Zea mays
gacactcggcaaagactttgc

SEQ ID NO: 1611 - DNA, 21 bp, Zea mays
cagctgacaccgaatgccgtg

SEQ ID NO: 1612 - DNA, 21 bp, Zea mays
ggtggtgtgtgcctgatacct

SEQ ID NO: 1613 - DNA, 21 bp, Zea mays
cgctgtggacttcgcgcatga

SEQ ID NO: 1614 - DNA, 21 bp, Zea mays
cgtgcgttgcaacggaaacat

SEQ ID NO: 1615 - DNA, 21 bp, Zea mays
atcgcgatccattaccacccc

SEQ ID NO: 1616 - DNA, 21 bp, Zea mays
cagacgccgccgaaaataagc

SEQ ID NO: 1617 - DNA, 21 bp, Zea mays
cagacgccgccgaaaatagct

SEQ ID NO: 1618 - DNA, 21 bp, Zea mays
acactcggcaaagtgactcaa

SEQ ID NO: 1619 - DNA, 21 bp, Zea mays
acagcctatggcgccgagcat

SEQ ID NO: 1620 - DNA, 21 bp, Zea mays
cctgccaaacaggcagcttct

SEQ ID NO: 1621 - DNA, 21 bp, Zea mays
aatgactgcagcggcgcctgc

SEQ ID NO: 1622 - DNA, 21 bp, Zea mays
cgagtgcgacactcggtaaag

SEQ ID NO: 1623 - DNA, 21 bp, Zea mays
gacaaacttgtgttgtggctt

SEQ ID NO: 1624 - DNA, 21 bp, Zea mays
gcttctttgccgagtgtctgc

SEQ ID NO: 1625 - DNA, 21 bp, Zea mays
tccgacccgacggattaggat

SEQ ID NO: 1626 - DNA, 21 bp, Zea mays
aaacacgactgagtgcagggt

SEQ ID NO: 1627 - DNA, 21 bp, Zea mays
ctcgcgcctctactgctgacg

SEQ ID NO: 1628 - DNA, 21 bp, Zea mays
cgtacatcgctgtgactggca

SEQ ID NO: 1629 - DNA, 21 bp, Zea mays
agtgagaagttgccggccggc

SEQ ID NO: 1630 - DNA, 21 bp, Zea mays
gaggatagaccccacccgcag

SEQ ID NO: 1631 - DNA, 21 bp, Zea mays
cagtctacgggttccttagag

SEQ ID NO: 1632 - DNA, 21 bp, Zea mays
cagtctttgccgagtgctttg

SEQ ID NO: 1633 - DNA, 21 bp, Zea mays
agcactcgacaaaagaaagca

SEQ ID NO: 1634 - DNA, 21 bp, Zea mays
aaatctaacccgcgctccctg

SEQ ID NO: 1635 - DNA, 21 bp, Zea mays
aaggctttgccgagtgttttt

SEQ ID NO: 1636 - DNA, 21 bp, Zea mays
aaaacactcggcaaagaactt

SEQ ID NO: 1637 - DNA, 21 bp, Zea mays
ggccgacccatttatcgggcc

SEQ ID NO: 1638 - DNA, 21 bp, Zea mays
cccgtgcgttgcgacggcata

SEQ ID NO: 1639 - DNA, 21 bp, Zea mays
gactctggtttcggctaattt

SEQ ID NO: 1640 - DNA, 21 bp, Zea mays
ctgccgttaatcgatctggac

SEQ ID NO: 1641 - DNA, 21 bp, Zea mays
gccacggacggtccagatcga

SEQ ID NO: 1642 - DNA, 21 bp, Zea mays
tgaggccttgttcgtttgtgt

SEQ ID NO: 1643 - DNA, 21 bp, Zea mays
atcaggctgcgttggtaatcg

SEQ ID NO: 1644 - DNA, 21 bp, Zea mays
catcctgcagacggcgtgcct

SEQ ID NO: 1645 - DNA, 21 bp, Zea mays
agccttctttgccgagtgcga

SEQ ID NO: 1646 - DNA, 21 bp, Zea mays
actcggcaaagagggctttgc

SEQ ID NO: 1647 - DNA, 21 bp, Zea mays
caagctttgccgagtgccagt

SEQ ID NO: 1648 - DNA, 21 bp, Zea mays
acgggccacgagtgaggccca

SEQ ID NO: 1649 - DNA, 21 bp, Zea mays
taagcttatgtccgacggtct

SEQ ID NO: 1650 - DNA, 21 bp, Zea mays
acgattccgggtgcaatccga

SEQ ID NO: 1651 - DNA, 21 bp, Zea mays
taagcttatgtccgacggcct

SEQ ID NO: 1652 - DNA, 21 bp, Zea mays
gagcagacacgacacagaggt

SEQ ID NO: 1653 - DNA, 21 bp, Zea mays
ggagggcaaggactcgccccc

SEQ ID NO: 1654 - DNA, 21 bp, Zea mays
gtctgtgcgttgcaacgagaa

SEQ ID NO: 1655 - DNA, 21 bp, Zea mays
atccgtcggcttaggactaac

SEQ ID NO: 1656 - DNA, 21 bp, Zea mays
ctttgccgagtgtttttttat

SEQ ID NO: 1657 - DNA, 21 bp, Zea mays
cggctttttgccgagtgctaa

SEQ ID NO: 1658 - DNA, 21 bp, Zea mays
cactcgactgtccaacccggt

SEQ ID NO: 1659 - DNA, 21 bp, Zea mays
ctgtgcactggagcagcatgg

SEQ ID NO: 1660 - DNA, 21 bp, Zea mays
agctgccaggagtaagtacta

SEQ ID NO: 1661 - DNA, 21 bp, Zea mays
caagctttgccgagtgccctc

SEQ ID NO: 1662 - DNA, 21 bp, Zea mays
ccggcacaactaaacaaggcc

SEQ ID NO: 1663 - DNA, 21 bp, Zea mays
taagcttatgtccgacggccg

SEQ ID NO: 1664 - DNA, 21 bp, Zea mays
gctgaatattggctgcgctct

SEQ ID NO: 1665 - DNA, 21 bp, Zea mays
acactcggcaaagtgaccagt

SEQ ID NO: 1666 - DNA, 21 bp, Zea mays
caaacgaacgcagcctaagtg

SEQ ID NO: 1667 - DNA, 21 bp, Zea mays
ggcgacgacttcgtacgacgg

SEQ ID NO: 1668 - DNA, 21 bp, Zea mays
tgtcgaagtcagtgctggacc

SEQ ID NO: 1669 - DNA, 21 bp, Zea mays
ctttgccgagtgccagcgatc

SEQ ID NO: 1670 - DNA, 21 bp, Zea mays
tctcagcaggaaatcagcaag

SEQ ID NO: 1671 - DNA, 21 bp, Zea mays
gctaacttcctagaggcccag

SEQ ID NO: 1672 - DNA, 21 bp, Zea mays
aacgctatgtccgacggcatc

SEQ ID NO: 1673 - DNA, 21 bp, Zea mays
acagccgtcggacataatctt

SEQ ID NO: 1674 - DNA, 21 bp, Zea mays
acggcggctttgccgagtgtc

SEQ ID NO: 1675 - DNA, 21 bp, Zea mays
tttctttgccgagtgcaccct

SEQ ID NO: 1676 - DNA, 21 bp, Zea mays
agcgaagctgaggcgtgctgc

SEQ ID NO: 1677 - DNA, 21 bp, Zea mays
cggaccgtgctttgagccagt

SEQ ID NO: 1678 - DNA, 21 bp, Zea mays
gactggcgggacacgtgtaca

SEQ ID NO: 1679 - DNA, 21 bp, Zea mays
acactcggcaaagacttcgcc

SEQ ID NO: 1680 - DNA, 21 bp, Zea mays
cggccggccggccggccacca

SEQ ID NO: 1681 - DNA, 21 bp, Zea mays
ggacaccatgactggcgcaga

SEQ ID NO: 1682 - DNA, 21 bp, Zea mays
cgctgtgactcaaccttgcgc

SEQ ID NO: 1683 - DNA, 21 bp, Zea mays
gcttctttgccgagtgtcaat

SEQ ID NO: 1684 - DNA, 21 bp, Zea mays
ggagctgggcgcgtgggcggg

SEQ ID NO: 1685 - DNA, 21 bp, Zea mays
atccgaagccatctgccatgg

SEQ ID NO: 1686 - DNA, 21 bp, Zea mays
aaagatactgggccagtttgg

SEQ ID NO: 1687 - DNA, 21 bp, Zea mays
cgaccgttgaaactggtgctt

SEQ ID NO: 1688 - DNA, 21 bp, Zea mays
ttggtctaaccgaacaagctc

SEQ ID NO: 1689 - DNA, 21 bp, Zea mays
gtgtaagcctgaatgacttgc

SEQ ID NO: 1690 - DNA, 21 bp, Zea mays
cttgcggcttgcctgcccggt

SEQ ID NO: 1691 - DNA, 21 bp, Zea mays
tccaacggtgctgcgtcaggg

SEQ ID NO: 1692 - DNA, 21 bp, Zea mays
caacggctagttgcgtctagg

SEQ ID NO: 1693 - DNA, 21 bp, Zea mays
gtatccgacccgataggaccg

SEQ ID NO: 1694 - DNA, 21 bp, Zea mays
aagcactcggcaaagaagccg

SEQ ID NO: 1695 - DNA, 21 bp, Zea mays
accgttgcaacgcacgggcac

SEQ ID NO: 1696 - DNA, 21 bp, Zea mays
ttggctgagtctgtggcaggc

SEQ ID NO: 1697 - DNA, 21 bp, Zea mays
tgtgggggaggcgagggatgg

SEQ ID NO: 1698 - DNA, 21 bp, Zea mays
gcttacatctagtatctgctt

SEQ ID NO: 1699 - DNA, 21 bp, Zea mays
gtcgaagacctcatagtgcca

SEQ ID NO: 1700 - DNA, 21 bp, Zea mays
cccgtgcgttgcaacggaacc

SEQ ID NO: 1701 - DNA, 21 bp, Zea mays
gaccgaattccgtccacgccc

SEQ ID NO: 1702 - DNA, 21 bp, Zea mays
tgatgctgcggtagtggtcct

SEQ ID NO: 1703 - DNA, 21 bp, Zea mays
gtttgggatggctacaggttc

SEQ ID NO: 1704 - DNA, 21 bp, Zea mays
gacactcggcaaagactttgt

SEQ ID NO: 1705 - DNA, 21 bp, Zea mays
actaggtgagtgcctgtgcgt

SEQ ID NO: 1706 - DNA, 21 bp, Zea mays
atggaccccacctgtaggcgc

SEQ ID NO: 1707 - DNA, 21 bp, Zea mays
acagcctatggcgccgaggta

SEQ ID NO: 1708 - DNA, 21 bp, Zea mays
gttgagcgactccgacgattt

SEQ ID NO: 1709 - DNA, 21 bp, Zea mays
cagcaaaactgagggcaccag

SEQ ID NO: 1710 - DNA, 21 bp, Zea mays
cagccagcagaacaagaccca

SEQ ID NO: 1711 - DNA, 21 bp, Zea mays
aggccttgttcgtttgtgtca

SEQ ID NO: 1712 - DNA, 21 bp, Zea mays
tagcctatggcgccgaggtac

SEQ ID NO: 1713 - DNA, 21 bp, Zea mays
cggctgacaaccgacgggttt

SEQ ID NO: 1714 - DNA, 21 bp, Zea mays
ataggagttccgtagttattg

SEQ ID NO: 1715 - DNA, 21 bp, Zea mays
cttgctgagttgctcgacggg

SEQ ID NO: 1716 - DNA, 21 bp, Zea mays
cagcccctcacaaaaatgagg

SEQ ID NO: 1717 - DNA, 21 bp, Zea mays
gtcgctctaaatcgctacagg

SEQ ID NO: 1718 - DNA, 21 bp, Zea mays
tggcactcggcaaagaaagct

SEQ ID NO: 1719 - DNA, 21 bp, Zea mays
tttgcgtggcactcggcaaag

SEQ ID NO: 1720 - DNA, 21 bp, Zea mays
gatgcttccatcatcacagct

SEQ ID NO: 1721 - DNA, 21 bp, Zea mays
tgggctgatttggtgaccagg

SEQ ID NO: 1722 - DNA, 21 bp, Zea mays
atgtgaccgttgatggacatg

SEQ ID NO: 1723 - DNA, 21 bp, Zea mays
aaatgacttgagaggtgtagg

SEQ ID NO: 1724 - DNA, 21 bp, Zea mays
aggcactcggcaaagaagttt

SEQ ID NO: 1725 - DNA, 21 bp, Zea mays
acgtctttgccgagtgtctga

SEQ ID NO: 1726 - DNA, 21 bp, Zea mays
cagacactcggcaaagacgtc

SEQ ID NO: 1727 - DNA, 21 bp, Zea mays
cgtccacgcccggtcgtactc

SEQ ID NO: 1728 - DNA, 21 bp, Zea mays
tcggcaaagtcctgctctcgg

SEQ ID NO: 1729 - DNA, 21 bp, Zea mays
tagggctagtttgggagccgt

SEQ ID NO: 1730 - DNA, 21 bp, Zea mays
ttctttgccgagtgccaccca

SEQ ID NO: 1731 - DNA, 21 bp, Zea mays
agcctttgccgagtgtccccg

SEQ ID NO: 1732 - DNA, 21 bp, Zea mays
taagcttatgtccgacggctg

SEQ ID NO: 1733 - DNA, 21 bp, Zea mays
gtcggaccaagattccacgat

SEQ ID NO: 1734 - DNA, 21 bp, Zea mays
gttggggtcatcacaggccgc

SEQ ID NO: 1735 - DNA, 21 bp, Zea mays
cagaagaatagacgaccagcc

SEQ ID NO: 1736 - DNA, 21 bp, Zea mays
gtctgtgcgttgcaacggaga

SEQ ID NO: 1737 - DNA, 21 bp, Zea mays
acctcatcgacggagaccgtg

SEQ ID NO: 1738 - DNA, 21 bp, Zea mays
gccggatttcggcggaccatt

SEQ ID NO: 1739 - DNA, 21 bp, Zea mays
gcgatgatgctcgctggggct

SEQ ID NO: 1740 - DNA, 21 bp, Zea mays
gtgtaagcctgaatgacttga

SEQ ID NO: 1741 - DNA, 21 bp, Zea mays
ggagactctggcggtcacgtc

SEQ ID NO: 1742 - DNA, 21 bp, Zea mays
tgcgctaacagacgtggggca

SEQ ID NO: 1743 - DNA, 21 bp, Zea mays
gagactttgccgagtgtttgg

SEQ ID NO: 1744 - DNA, 21 bp, Zea mays
gcgtgggacgggcttagcacc

SEQ ID NO: 1745 - DNA, 21 bp, Zea mays
ggcgtcccaggcctccttgaa

SEQ ID NO: 1746 - DNA, 21 bp, Zea mays
gaagatcgggcatcgtgacac

SEQ ID NO: 1747 - DNA, 21 bp, Zea mays
ccatagatcttggcgccgaga

SEQ ID NO: 1748 - DNA, 21 bp, Zea mays
gccaagatctatggcgtcgag

SEQ ID NO: 1749 - DNA, 21 bp, Zea mays
caagcggcagaagcgggacca

SEQ ID NO: 1750 - DNA, 21 bp, Zea mays
ctcgcgcagtggctattgcac

SEQ ID NO: 1751 - DNA, 21 bp, Zea mays
acactcggcaaagactttatc

SEQ ID NO: 1752 - DNA, 21 bp, Zea mays
gactttgtgtgcggtgtggcc

SEQ ID NO: 1753 - DNA, 21 bp, Zea mays
tgcttggactttggatcgctg

SEQ ID NO: 1754 - DNA, 21 bp, Zea mays
acagcctatggcgccgaggtt

SEQ ID NO: 1755 - DNA, 21 bp, Zea mays
tagggctagtttgggagccta

SEQ ID NO: 1756 - DNA, 21 bp, Zea mays
gctgatttggtgaccagagat

SEQ ID NO: 1757 - DNA, 21 bp, Zea mays
ttgcagcggaaatcttattac

SEQ ID NO: 1758 - DNA, 21 bp, Zea mays
cgtgggtacccacgttcttcg

SEQ ID NO: 1759 - DNA, 21 bp, Zea mays
ccttgaccctgactctgtacc

SEQ ID NO: 1760 - DNA, 21 bp, Zea mays
attctagtttgcagccgtctg

SEQ ID NO: 1761 - DNA, 21 bp, Zea mays
gattgaccacacctgtaggtt

SEQ ID NO: 1762 - DNA, 21 bp, Zea mays
gcttctttgccgagtgtctga

SEQ ID NO: 1763 - DNA, 21 bp, Zea mays
acagcctatggcgccgaaatc

SEQ ID NO: 1764 - DNA, 21 bp, Zea mays
cagacactcggcaaagaagcc

SEQ ID NO: 1765 - DNA, 21 bp, Zea mays
ctggcactcgacaaagagtat

SEQ ID NO: 1766 - DNA, 21 bp, Zea mays
tttctttgccgagtgccctac

SEQ ID NO: 1767 - DNA, 21 bp, Zea mays
acgacgaagctgggcgagctc

SEQ ID NO: 1768 - DNA, 21 bp, Zea mays
gaaggccgaagaggagaaagg

SEQ ID NO: 1769 - DNA, 21 bp, Zea mays
caagcgctcgacaaattgctt

SEQ ID NO: 1770 - DNA, 21 bp, Zea mays
ttttacatcacaggcggttca

SEQ ID NO: 1771 - DNA, 21 bp, Zea mays
tagtccctagaaaccaaacgt

SEQ ID NO: 1772 - DNA, 21 bp, Zea mays
ctttgccgagtgccagcaatc

SEQ ID NO: 1773 - DNA, 21 bp, Zea mays
cgtgacgtaagccaacgagcg

SEQ ID NO: 1774 - DNA, 21 bp, Zea mays
ggcaaagtgtggcaagttagc

SEQ ID NO: 1775 - DNA, 21 bp, Zea mays
actccctcgggatgactgcgt

SEQ ID NO: 1776 - DNA, 21 bp, Zea mays
gtgacactcggcaaagagatt

SEQ ID NO: 1777 - DNA, 21 bp, Zea mays
acctcagttgccacatttgcc

SEQ ID NO: 1778 - DNA, 21 bp, Zea mays
gaagagttgcctactcctcca

SEQ ID NO: 1779 - DNA, 21 bp, Zea mays
aggccttgttcgtttctaccg

SEQ ID NO: 1780 - DNA, 21 bp, Zea mays
aaaagcactcggcaaagccgc

SEQ ID NO: 1781 - DNA, 21 bp, Zea mays
gacggcgacagagtggacgga

SEQ ID NO: 1782 - DNA, 21 bp, Zea mays
gcttctttgccgagtgtccgg

SEQ ID NO: 1783 - DNA, 21 bp, Zea mays
cagcactccgcatgcggctcc

SEQ ID NO: 1784 - DNA, 21 bp, Zea mays
aaaagcactcggcaaagagct

SEQ ID NO: 1785 - DNA, 21 bp, Zea mays
actcgacaaagcgccctacag

SEQ ID NO: 1786 - DNA, 21 bp, Zea mays
gtggctaagaggggaggttct

SEQ ID NO: 1787 - DNA, 21 bp, Zea mays
tggctctcggcaaagactctc

SEQ ID NO: 1788 - DNA, 21 bp, Zea mays
aaggctctcggcaaagacgtc

SEQ ID NO: 1789 - DNA, 21 bp, Zea mays
acaaagacgtctttgccgaga

SEQ ID NO: 1790 - DNA, 21 bp, Zea mays
ggaccaggtccagacgtctat

SEQ ID NO: 1791 - DNA, 21 bp, Zea mays
gctaacttcctagaggcggtc

SEQ ID NO: 1792 - DNA, 21 bp, Zea mays
tcggcgtggctaaggttgtaa

SEQ ID NO: 1793 - DNA, 21 bp, Zea mays
aatcatcgcgtgcgttgactt

SEQ ID NO: 1794 - DNA, 21 bp, Zea mays
aaaagcactcggcaaagcgcc

SEQ ID NO: 1795 - DNA, 21 bp, Zea mays
cggcactcggcaaagccggat

SEQ ID NO: 1796 - DNA, 21 bp, Zea mays
agctgccaggagtaagtacgc

SEQ ID NO: 1797 - DNA, 21 bp, Zea mays
taggatgtgtttggttgggga

SEQ ID NO: 1798 - DNA, 21 bp, Zea mays
gacactcggcaaagactttgg

SEQ ID NO: 1799 - DNA, 21 bp, Zea mays
tgttttgccgagtgcctccta

SEQ ID NO: 1800 - DNA, 21 bp, Zea mays
agcctttgccgagtgtcacca

SEQ ID NO: 1801 - DNA, 21 bp, Zea mays
taggcgagtcgtgactgcgcc

SEQ ID NO: 1802 - DNA, 21 bp, Zea mays
gaaacgaacaaggcctaagtt

SEQ ID NO: 1803 - DNA, 21 bp, Zea mays
cactcggcaaagaacccgcta

SEQ ID NO: 1804 - DNA, 21 bp, Zea mays
gacggctatactgacagccat

SEQ ID NO: 1805 - DNA, 21 bp, Zea mays
aagcacttgagcagccatatt

SEQ ID NO: 1806 - DNA, 21 bp, Zea mays
gcctcgggcgactactctggg

SEQ ID NO: 1807 - DNA, 21 bp, Zea mays
agcaacgaccgtcgtcccagc

SEQ ID NO: 1808 - DNA, 21 bp, Zea mays
cgcatgcggccacgtaggact

SEQ ID NO: 1809 - DNA, 21 bp, Zea mays
ttatgtccgacggctttcaga

SEQ ID NO: 1810 - DNA, 21 bp, Zea mays
aaacgaacaaggcctaagcca

SEQ ID NO: 1811 - DNA, 21 bp, Zea mays
acctacagcggcaggaatggc

SEQ ID NO: 1812 - DNA, 21 bp, Zea mays
gccaagatctatggcgcatga

SEQ ID NO: 1813 - DNA, 21 bp, Zea mays
ctcgggtgcgcatgagtaagg

SEQ ID NO: 1814 - DNA, 21 bp, Zea mays
acctcagttgccacattttgc

SEQ ID NO: 1815 - DNA, 21 bp, Zea mays
tttgccgagtgccgccgtgac

SEQ ID NO: 1816 - DNA, 21 bp, Zea mays
gccgcctctaggaagttagcg

SEQ ID NO: 1817 - DNA, 21 bp, Zea mays
gctaacttcctagaggcggcc

SEQ ID NO: 1818 - DNA, 21 bp, Zea mays
cgcactcggcaaagaacctat

SEQ ID NO: 1819 - DNA, 21 bp, Zea mays
gcggtgtcatggttgttctgg

SEQ ID NO: 1820 - DNA, 21 bp, Zea mays
atcgtcggggtagcttttgtg

SEQ ID NO: 1821 - DNA, 21 bp, Zea mays
acagccgtcggacataatgga

SEQ ID NO: 1822 - DNA, 21 bp, Zea mays
aggccttgttcgtttctgctg

SEQ ID NO: 1823 - DNA, 21 bp, Zea mays
ctgagcccggaggacttggaa

SEQ ID NO: 1824 - DNA, 21 bp, Zea mays
gcttctttgccgagtgtcatc

SEQ ID NO: 1825 - DNA, 21 bp, Zea mays
tttggacccttagctcggcgc

SEQ ID NO: 1826 - DNA, 21 bp, Zea mays
gcttctttgccgagtgtccca

SEQ ID NO: 1827 - DNA, 21 bp, Zea mays
ctttgccgagtgccagctggt

SEQ ID NO: 1828 - DNA, 21 bp, Zea mays
cagaccgtcggacataatctt

SEQ ID NO: 1829 - DNA, 21 bp, Zea mays
acgcagtcacgactcgcctga

SEQ ID NO: 1830 - DNA, 21 bp, Zea mays
gtgatagtcttttggatgatt

SEQ ID NO: 1831 - DNA, 21 bp, Zea mays
cgagcagtcatcggacagcgg

SEQ ID NO: 1832 - DNA, 21 bp, Zea mays
agccttctttgccgagtgttg

SEQ ID NO: 1833 - DNA, 21 bp, Zea mays
ttggtcaaccaatccattcct

SEQ ID NO: 1834 - DNA, 21 bp, Zea mays
agctcagctcaggagtgatcc

SEQ ID NO: 1835 - DNA, 21 bp, Zea mays
gatgtggctcggcaacgataa

SEQ ID NO: 1836 - DNA, 21 bp, Zea mays
gcgatctgattggtccacgtg

SEQ ID NO: 1837 - DNA, 21 bp, Zea mays
cccgtgcgttgcgacggcacg

SEQ ID NO: 1838 - DNA, 21 bp, Zea mays
aagacgaagctagcagcgtga

SEQ ID NO: 1839 - DNA, 21 bp, Zea mays
gaggaggccgtagaaagttag

SEQ ID NO: 1840 - DNA, 21 bp, Zea mays
ccgtgtgaagcagaccgcccg

SEQ ID NO: 1841 - DNA, 21 bp, Zea mays
ttatgtccgacggctttcctg

SEQ ID NO: 1842 - DNA, 21 bp, Zea mays
atctccagagccaggctccca

SEQ ID NO: 1843 - DNA, 21 bp, Zea mays
aaggccttgttcgtttgcatc

SEQ ID NO: 1844 - DNA, 21 bp, Zea mays
ccgtgtctatgactggtggga

SEQ ID NO: 1845 - DNA, 21 bp, Zea mays
agtgcctaagtcacgcctcag

SEQ ID NO: 1846 - DNA, 21 bp, Zea mays
agccttctttgccgagtgtca

SEQ ID NO: 1847 - DNA, 21 bp, Zea mays
gtcagcagatcacgagcagtc

SEQ ID NO: 1848 - DNA, 21 bp, Zea mays
tccacgtgcggctggactgtg

SEQ ID NO: 1849 - DNA, 21 bp, Zea mays
acctcagttgccacactttgt

SEQ ID NO: 1850 - DNA, 21 bp, Zea mays
atggctttgttggagaggtga

SEQ ID NO: 1851 - DNA, 21 bp, Zea mays
gtgagccgtcgcaacgcacgg

SEQ ID NO: 1852 - DNA, 21 bp, Zea mays
caaaagcccatataagtggat

SEQ ID NO: 1853 - DNA, 21 bp, Zea mays
gctgactgtagcccctaggaa

SEQ ID NO: 1854 - DNA, 21 bp, Zea mays
aaaacactcggcaaagagcca

SEQ ID NO: 1855 - DNA, 21 bp, Zea mays
ctgcttgcctgctgctgaaat

SEQ ID NO: 1856 - DNA, 21 bp, Zea mays
gattagtgggttgtcgccaga

SEQ ID NO: 1857 - DNA, 21 bp, Zea mays
acttcgccagtgcttatcaac

SEQ ID NO: 1858 - DNA, 21 bp, Zea mays
cttccgtacaatgtgctcgcg

SEQ ID NO: 1859 - DNA, 21 bp, Zea mays
acagacacgtcatgccggctt

SEQ ID NO: 1860 - DNA, 21 bp, Zea mays
aaccgaacaaggcctaaatgg

SEQ ID NO: 1861 - DNA, 21 bp, Zea mays
gtgtcaaaaacaggtggtggc

SEQ ID NO: 1862 - DNA, 21 bp, Zea mays
cgtgggtacccacgttctgaa

SEQ ID NO: 1863 - DNA, 21 bp, Zea mays
ggcaaagactttgccgagggg

SEQ ID NO: 1864 - DNA, 21 bp, Zea mays
agagtgactccataaaccaat

SEQ ID NO: 1865 - DNA, 21 bp, Zea mays
cagacactcggcaaagagtct

SEQ ID NO: 1866 - DNA, 21 bp, Zea mays
taggctgtctccagcaacgtc

SEQ ID NO: 1867 - DNA, 21 bp, Zea mays
aagggtgcgtttggttgaatg

SEQ ID NO: 1868 - DNA, 21 bp, Zea mays
agatcttggcgccgagctacc

SEQ ID NO: 1869 - DNA, 21 bp, Zea mays
atgaacttgtgagcgtctgag

SEQ ID NO: 1870 - DNA, 21 bp, Zea mays
caaagactttgccgagtgtca

SEQ ID NO: 1871 - DNA, 21 bp, Zea mays
acgcgatcgaacacgtggagg

SEQ ID NO: 1872 - DNA, 21 bp, Zea mays
gtgacacagttagccacaaac

SEQ ID NO: 1873 - DNA, 21 bp, Zea mays
gtgacactcggcaaagagtct

SEQ ID NO: 1874 - DNA, 21 bp, Zea mays
gggaccctgttgtgagtggcc

SEQ ID NO: 1875 - DNA, 21 bp, Zea mays
aagcactcggcaaagaacctg

SEQ ID NO: 1876 - DNA, 21 bp, Zea mays
gaaagtcaaacgcttgatatg

SEQ ID NO: 1877 - DNA, 21 bp, Zea mays
cccccccccccccccccaaaa

SEQ ID NO: 1878 - DNA, 21 bp, Zea mays
aaacacgactgagtgcagtgc

SEQ ID NO: 1879 - DNA, 21 bp, Zea mays
gccaagatctatgacgctgat

SEQ ID NO: 1880 - DNA, 21 bp, Zea mays
agatcttggcgccgagctagc

SEQ ID NO: 1881 - DNA, 21 bp, Zea mays
caagtccgactcaactttgcc

SEQ ID NO: 1882 - DNA, 21 bp, Zea mays
cagcagcgtcccctaaattcg

SEQ ID NO: 1883 - DNA, 21 bp, Zea mays
agagagagacagacagacaga

SEQ ID NO: 1884 - DNA, 21 bp, Zea mays
ccatagatcttggcgcctacc

SEQ ID NO: 1885 - DNA, 21 bp, Zea mays
gccaagatctatggcgcctaa

SEQ ID NO: 1886 - DNA, 21 bp, Zea mays
ggcggtctggcgaagtgtgat

SEQ ID NO: 1887 - DNA, 21 bp, Zea mays
caggactttgccgagtgcggc

SEQ ID NO: 1888 - DNA, 21 bp, Zea mays
tttctttgccgagtgcccgcg

SEQ ID NO: 1889 - DNA, 21 bp, Zea mays
caagatctgtggcgccaagct

SEQ ID NO: 1890 - DNA, 21 bp, Zea mays
gtgccacagatcttggtgcca

SEQ ID NO: 1891 - DNA, 21 bp, Zea mays
gcaacgacttcatacggcggg

SEQ ID NO: 1892 - DNA, 21 bp, Zea mays
ggggccgtcggacataagcgc

SEQ ID NO: 1893 - DNA, 21 bp, Zea mays
atagtgccgtgcctaatagtg

SEQ ID NO: 1894 - DNA, 21 bp, Zea mays
tgctcgacaaggacctaatcg

SEQ ID NO: 1895 - DNA, 21 bp, Zea mays
tccgacccaccaatccataac

SEQ ID NO: 1896 - DNA, 21 bp, Zea mays
caagttattgggcccacatgc

SEQ ID NO: 1897 - DNA, 21 bp, Zea mays
ctggcatgtgtctgggaagcg

SEQ ID NO: 1898 - DNA, 21 bp, Zea mays
caagttattgggcccacgtac

SEQ ID NO: 1899 - DNA, 21 bp, Zea mays
ggggccgtcggacataagacg

SEQ ID NO: 1900 - DNA, 21 bp, Zea mays
aatcggggtggagcgtaaaaa

SEQ ID NO: 1901 - DNA, 21 bp, Zea mays
tccaatcaggatctcggtaga

SEQ ID NO: 1902 - DNA, 21 bp, Zea mays
cagacgtagggcggctatccc

SEQ ID NO: 1903 - DNA, 21 bp, Zea mays
gagctgagctggttcctgtca

SEQ ID NO: 1904 - DNA, 21 bp, Zea mays
caagttattgggtccacatgt

SEQ ID NO: 1905 - DNA, 21 bp, Zea mays
ggggccgtcggacataaggct

SEQ ID NO: 1906 - DNA, 21 bp, Zea mays
aggcgtcctcagcgacggact

SEQ ID NO: 1907 - DNA, 21 bp, Zea mays
tgcccgtgcgttgcaacgaga

SEQ ID NO: 1908 - DNA, 21 bp, Zea mays
actttaccgagtgcggctctc

SEQ ID NO: 1909 - DNA, 21 bp, Zea mays
caagatgcagttggtggacga

SEQ ID NO: 1910 - DNA, 21 bp, Zea mays
ccaagaggaggaccaggagca

SEQ ID NO: 1911 - DNA, 21 bp, Zea mays
cctgacatgtgggcccatgaa

SEQ ID NO: 1912 - DNA, 21 bp, Zea mays
ctctgccaccgtagaccggcc

SEQ ID NO: 1913 - DNA, 21 bp, Zea mays
gaacagggcctaaggggagtc

SEQ ID NO: 1914 - DNA, 21 bp, Zea mays
gcctcggtttgctgcgtggac

SEQ ID NO: 1915 - DNA, 21 bp, Zea mays
ggacggtcgagtgggatggag

SEQ ID NO: 1916 - DNA, 21 bp, Zea mays
agctgtccacgaggaagacca

SEQ ID NO: 1917 - DNA, 21 bp, Zea mays
agcactcggcaaagggaccga

SEQ ID NO: 1918 - DNA, 21 bp, Zea mays
ctggtgcgggtgcctctcggt

SEQ ID NO: 1919 - DNA, 21 bp, Zea mays
gtgaagatcgggcatcgtgac

SEQ ID NO: 1920 - DNA, 21 bp, Zea mays
tatcgggcactcggcaaagaa

SEQ ID NO: 1921 - DNA, 21 bp, Zea mays
gcttatgtccgacggtcttct

SEQ ID NO: 1922 - DNA, 21 bp, Zea mays
cgataccagctgtggcggaac

SEQ ID NO: 1923 - DNA, 21 bp, Zea mays
gtgacactcgacaaagaatat

SEQ ID NO: 1924 - DNA, 21 bp, Zea mays
ttggttgcaatgacaggacag

SEQ ID NO: 1925 - DNA, 21 bp, Zea mays
cgttgcagcgatggcggccag

SEQ ID NO: 1926 - DNA, 21 bp, Zea mays
ttgctccggcacgaggatgta

SEQ ID NO: 1927 - DNA, 21 bp, Zea mays
gcttggatcacgtctctgtgg

SEQ ID NO: 1928 - DNA, 21 bp, Zea mays
acaaaccaaacaagcccttac

SEQ ID NO: 1929 - DNA, 21 bp, Zea mays
tctcggacgggcctggctgcg

SEQ ID NO: 1930 - DNA, 21 bp, Zea mays
gctagcactcggcaaaggcga

SEQ ID NO: 1931 - DNA, 21 bp, Zea mays
gctagcactcggcaaagtcgc

SEQ ID NO: 1932 - DNA, 21 bp, Zea mays
ctgggatttggacgttgttgc

SEQ ID NO: 1933 - DNA, 21 bp, Zea mays
gaagctgctgggtggcgaagc

SEQ ID NO: 1934 - DNA, 21 bp, Zea mays
cgttgctgggcgcgttgagga

SEQ ID NO: 1935 - DNA, 21 bp, Zea mays
gtcgtccgtcctgagtccaat

SEQ ID NO: 1936 - DNA, 21 bp, Zea mays
ttgcaacgcacgggcactgag

SEQ ID NO: 1937 - DNA, 21 bp, Zea mays
caggcactcggcaaagaggct

SEQ ID NO: 1938 - DNA, 21 bp, Zea mays
gcaaacgaccttcgggctggg

SEQ ID NO: 1939 - DNA, 21 bp, Zea mays
cagcacgagcacgacccgaaa

SEQ ID NO: 1940 - DNA, 21 bp, Zea mays
ggttggtcacctggctgctct

SEQ ID NO: 1941 - DNA, 21 bp, Zea mays
ttctttgccgagtgccggatc

SEQ ID NO: 1942 - DNA, 21 bp, Zea mays
ctctttgccgagtgccagatg

SEQ ID NO: 1943 - DNA, 21 bp, Zea mays
cgtgctcgggctagcccaacg

SEQ ID NO: 1944 - DNA, 21 bp, Zea mays
tgcaggcacgcacctcacatc

SEQ ID NO: 1945 - DNA, 21 bp, Zea mays
ggggaaccgctgcgggagatg

SEQ ID NO: 1946 - DNA, 21 bp, Zea mays
tgcgtttggttgcgggtcagc

SEQ ID NO: 1947 - DNA, 21 bp, Zea mays
gtgctcgtgcgtcacaggccc

SEQ ID NO: 1948 - DNA, 21 bp, Zea mays
cgaactcgaggtggcgccgct

SEQ ID NO: 1949 - DNA, 21 bp, Zea mays
aggagcccgacgtctgctcga

SEQ ID NO: 1950 - DNA, 21 bp, Zea mays
ttctttgccgagtgccgtgtt

SEQ ID NO: 1951 - DNA, 21 bp, Zea mays
aagcacgagcaactggctagt

SEQ ID NO: 1952 - DNA, 21 bp, Zea mays
gttccaggagtgctccaggtc

SEQ ID NO: 1953 - DNA, 21 bp, Zea mays
tttctttgccgagtgcacgag

SEQ ID NO: 1954 - DNA, 21 bp, Zea mays
tccggtgaagtggtcgaggac

SEQ ID NO: 1955 - DNA, 21 bp, Zea mays
ggcgattccacggctaggttc

SEQ ID NO: 1956 - DNA, 21 bp, Zea mays
cgggcactcggcaaagatctg

SEQ ID NO: 1957 - DNA, 21 bp, Zea mays
cgaggctgaggccgagctgct

SEQ ID NO: 1958 - DNA, 21 bp, Zea mays
agcaaaacgcttaggcccctc

SEQ ID NO: 1959 - DNA, 21 bp, Zea mays
gacactcggcaaagaagcttt

SEQ ID NO: 1960 - DNA, 21 bp, Zea mays
gaggacaaagtgcgcacaaaa

SEQ ID NO: 1961 - DNA, 21 bp, Zea mays
gaccctcgcggtttcacgggc

SEQ ID NO: 1962 - DNA, 21 bp, Zea mays
tgagcgatttggcggcggtgg

SEQ ID NO: 1963 - DNA, 21 bp, Zea mays
gcagcggtgcggcttcaggcg

SEQ ID NO: 1964 - DNA, 21 bp, Zea mays
ctctttgccgagtgccaaatg

SEQ ID NO: 1965 - DNA, 21 bp, Zea mays
gcctcgctgggttgctcagca

SEQ ID NO: 1966 - DNA, 21 bp, Zea mays
caggcactcggcaaagaagtt

SEQ ID NO: 1967 - DNA, 21 bp, Zea mays
cccggtggcagggtggtaggc

SEQ ID NO: 1968 - DNA, 21 bp, Zea mays
caccacctgctgcttgaccga

SEQ ID NO: 1969 - DNA, 21 bp, Zea mays
catacggttatgtccgacggc

SEQ ID NO: 1970 - DNA, 21 bp, Zea mays
tgtactgacccttgccaccgg

SEQ ID NO: 1971 - DNA, 21 bp, Zea mays
ctggtgcgggtgcctcttggt

SEQ ID NO: 1972 - DNA, 21 bp, Zea mays
tccacggtctgagccgccagc

SEQ ID NO: 1973 - DNA, 21 bp, Zea mays
cgtggaccgagcgattccggc

SEQ ID NO: 1974 - DNA, 21 bp, Zea mays
gttccaggagtgctccaagtc

SEQ ID NO: 1975 - DNA, 21 bp, Zea mays
gacgacgacgacgacgcgccc

SEQ ID NO: 1976 - DNA, 21 bp, Zea mays
gcaaacaaccattaggtgcaa

SEQ ID NO: 1977 - DNA, 21 bp, Zea mays
aacgctgcatgtgcgggagca

SEQ ID NO: 1978 - DNA, 21 bp, Zea mays
ggcgggcgagagggaggcgag

SEQ ID NO: 1979 - DNA, 21 bp, Zea mays
cgggcgagagcgaggcgatac

SEQ ID NO: 1980 - DNA, 21 bp, Zea mays
tgaggagtcgtcggaggagga

SEQ ID NO: 1981 - DNA, 21 bp, Zea mays
ggaagatcgggccgcgtctac

SEQ ID NO: 1982 - DNA, 21 bp, Zea mays
ccctctgggtgagcgcgattt

SEQ ID NO: 1983 - DNA, 21 bp, Zea mays
ctgattggatgaccgcaccca

SEQ ID NO: 1984 - DNA, 21 bp, Zea mays
aggggcgagagtggaggcgag

SEQ ID NO: 1985 - DNA, 21 bp, Zea mays
cctcggtccgcgtgcaagata

SEQ ID NO: 1986 - DNA, 21 bp, Zea mays
aggcgacttttgctcggacgc

SEQ ID NO: 1987 - DNA, 21 bp, Zea mays
tgaaccaaacaggcccttagt

SEQ ID NO: 1988 - DNA, 21 bp, Zea mays
ggactaggcaggcttttgctt

SEQ ID NO: 1989 - DNA, 21 bp, Zea mays
acaagccccgactcttcgcta

SEQ ID NO: 1990 - DNA, 21 bp, Zea mays
gtgtctgagacacacggcaaa

SEQ ID NO: 1991 - DNA, 21 bp, Zea mays
gcagattggtcgcatctctag

SEQ ID NO: 1992 - DNA, 21 bp, Zea mays
caccctaaacactgtgctgtg

SEQ ID NO: 1993 - DNA, 21 bp, Zea mays
atcattggcgggtggctgaga

SEQ ID NO: 1994 - DNA, 21 bp, Zea mays
ccagcggggtgctggttgggc

SEQ ID NO: 1995 - DNA, 21 bp, Zea mays
ggcgcgcaggctgcgagttgc

SEQ ID NO: 1996 - DNA, 21 bp, Zea mays
ggggagtttggctggggcggc

SEQ ID NO: 1997 - DNA, 21 bp, Zea mays
ggacataggttgatgccgtcg

SEQ ID NO: 1998 - DNA, 21 bp, Zea mays
cgccagggccaccctgcagat

SEQ ID NO: 1999 - DNA, 21 bp, Zea mays
ctgacaagcgatgtgccgcct

SEQ ID NO: 2000 - DNA, 21 bp, Zea mays
gactgagtgcagggcgaccag

SEQ ID NO: 2001 - DNA, 21 bp, Zea mays
ctggattaaagccgcagcgaa

SEQ ID NO: 2002 - DNA, 21 bp, Zea mays
gcctcgctgggttgctcagcg

SEQ ID NO: 2003 - DNA, 21 bp, Zea mays
gatgagtaggagggcgcggcg

SEQ ID NO: 2004 - DNA, 21 bp, Zea mays
tttttgacactcggcaaaaag

SEQ ID NO: 2005 - DNA, 21 bp, Zea mays
ctcatgtgcgctgacgcctat

SEQ ID NO: 2006 - DNA, 21 bp, Zea mays
cttccgcaggagaggaccagg

SEQ ID NO: 2007 - DNA, 21 bp, Zea mays
cataaagtagcgcgtgcacct

SEQ ID NO: 2008 - DNA, 21 bp, Zea mays
cttgaccatgggagccagcga

SEQ ID NO: 2009 - DNA, 21 bp, Zea mays
cgttcccggttgcaactcgat

SEQ ID NO: 2010 - DNA, 21 bp, Zea mays
tttttgacactcggcaaagaa

SEQ ID NO: 2011 - DNA, 21 bp, Zea mays
cccgacctcgacgtgcggtgg

SEQ ID NO: 2012 - DNA, 21 bp, Zea mays
cgtcgtcctcctggtgtggct

SEQ ID NO: 2013 - DNA, 21 bp, Zea mays
agggttgtgggccgttggatg

SEQ ID NO: 2014 - DNA, 21 bp, Zea mays
ctctttgccgagtgccagccg

SEQ ID NO: 2015 - DNA, 21 bp, Zea mays
tggacgagcggctgtaaatga

SEQ ID NO: 2016 - DNA, 21 bp, Zea mays
ggcaaagtgtgacaagttatg

SEQ ID NO: 2017 - DNA, 21 bp, Zea mays
catggtcgtcaccgtcgtcct

SEQ ID NO: 2018 - DNA, 21 bp, Zea mays
ccacagatcttggcgccgagc

SEQ ID NO: 2019 - DNA, 21 bp, Zea mays
aggcttcgcaggaccttgtga

SEQ ID NO: 2020 - DNA, 21 bp, Zea mays
cgacgcggcttgcggcggtgg

SEQ ID NO: 2021 - DNA, 21 bp, Zea mays
cgggcactcggcaaagaagtc

SEQ ID NO: 2022 - DNA, 21 bp, Zea mays
gagtcctcgacgcagggccgc

SEQ ID NO: 2023 - DNA, 21 bp, Zea mays
gccgaacgcgacccagatcac

SEQ ID NO: 2024 - DNA, 21 bp, Zea mays
ccacgtatcgtggactgagca

SEQ ID NO: 2025 - DNA, 21 bp, Zea mays
ccgcggacgctgtcgagcccg

SEQ ID NO: 2026 - DNA, 21 bp, Zea mays
gtggattgggtgggattgagt

SEQ ID NO: 2027 - DNA, 21 bp, Zea mays
gacactcggcaaagaagtaat

SEQ ID NO: 2028 - DNA, 21 bp, Zea mays
cctactgctgttgggagggtt

SEQ ID NO: 2029 - DNA, 21 bp, Zea mays
ctactgccgccgataagcccc

SEQ ID NO: 2030 - DNA, 21 bp, Zea mays
ctgtagggcgaagacgcggtc

SEQ ID NO: 2031 - DNA, 21 bp, Zea mays
ccagccagagcgcctgagtca

SEQ ID NO: 2032 - DNA, 21 bp, Zea mays
gctgtccaccctgagttccac

SEQ ID NO: 2033 - DNA, 21 bp, Zea mays
gatgttcgagcgagcgatgtc

SEQ ID NO: 2034 - DNA, 21 bp, Zea mays
ggtatagagtgccttgctggg

SEQ ID NO: 2035 - DNA, 21 bp, Zea mays
caggccttgttcgtttgtgtc

SEQ ID NO: 2036 - DNA, 21 bp, Zea mays
aggcgacttttgctcggatga

SEQ ID NO: 2037 - DNA, 21 bp, Zea mays
gtggcagggtggtaggccaag

SEQ ID NO: 2038 - DNA, 21 bp, Zea mays
tccaatcccggaggcggtagg

SEQ ID NO: 2039 - DNA, 21 bp, Zea mays
ggtgaagcgaagggtgagact

SEQ ID NO: 2040 - DNA, 21 bp, Zea mays
gccaagatctacggcgccgag

SEQ ID NO: 2041 - DNA, 21 bp, Zea mays
cttggcgactgccagttcgac

SEQ ID NO: 2042 - DNA, 21 bp, Zea mays
caaattggcacggcacgacca

SEQ ID NO: 2043 - DNA, 21 bp, Zea mays
tgacggaactgttcgcgggga

SEQ ID NO: 2044 - DNA, 21 bp, Zea mays
aagaaccgcctgtgatagaca

SEQ ID NO: 2045 - DNA, 21 bp, Zea mays
gtgccggtgggctcggccttc

SEQ ID NO: 2046 - DNA, 21 bp, Zea mays
gccatagatcttggcgccgag

SEQ ID NO: 2047 - DNA, 21 bp, Zea mays
ggcgtcgtcgtcggatgtggt

SEQ ID NO: 2048 - DNA, 21 bp, Zea mays
gaaccgaggaaccgaaccgaa

SEQ ID NO: 2049 - DNA, 21 bp, Zea mays
cgctcaggcggagacccgatc

SEQ ID NO: 2050 - DNA, 21 bp, Zea mays
attacgctccggcggcccgaa

SEQ ID NO: 2051 - DNA, 21 bp, Zea mays
aaccgaacaagccctaaggtg

SEQ ID NO: 2052 - DNA, 21 bp, Zea mays
agaacggagccgttccattcc

SEQ ID NO: 2053 - DNA, 21 bp, Zea mays
cttctacgcctagcactacac

SEQ ID NO: 2054 - DNA, 21 bp, Zea mays
ctctgccaccgtagaccggct

SEQ ID NO: 2055 - DNA, 21 bp, Zea mays
tgagtgcccgtgcgttgcaac

SEQ ID NO: 2056 - DNA, 21 bp, Zea mays
cagccaggctacggggagaag

SEQ ID NO: 2057 - DNA, 21 bp, Zea mays
gtgttggtcgattaagacagc

SEQ ID NO: 2058 - DNA, 21 bp, Zea mays
ctctttgccgagtgccaggac

SEQ ID NO: 2059 - DNA, 21 bp, Zea mays
cccttcggtgcgccgccggcc

SEQ ID NO: 2060 - DNA, 21 bp, Zea mays
gtgacgtaagccaacgggcgg

SEQ ID NO: 2061 - DNA, 21 bp, Zea mays
catcacaggcggttcggatag

SEQ ID NO: 2062 - DNA, 21 bp, Zea mays
aagaaccgcctgtgatagtca

SEQ ID NO: 2063 - DNA, 21 bp, Zea mays
aggctctgggccggtggggtc

SEQ ID NO: 2064 - DNA, 21 bp, Zea mays
gaggacggcggcgtgatttgc

SEQ ID NO: 2065 - DNA, 21 bp, Zea mays
ttccttatgtccgacggtttt

SEQ ID NO: 2066 - DNA, 21 bp, Zea mays
cgggcactcggcaaagaagga

SEQ ID NO: 2067 - DNA, 21 bp, Zea mays
gtcagcagggtggacaggcga

SEQ ID NO: 2068 - DNA, 21 bp, Zea mays
cccgtgcgttgcgacggctca

SEQ ID NO: 2069 - DNA, 21 bp, Zea mays
gacactcggcaaagaagctct

SEQ ID NO: 2070 - DNA, 21 bp, Zea mays
actgttggactgcgggtttct

SEQ ID NO: 2071 - DNA, 21 bp, Zea mays
cgaagtctttgccgagtgtga

SEQ ID NO: 2072 - DNA, 21 bp, Zea mays
agcctttgccgagtgtcacgg

SEQ ID NO: 2073 - DNA, 21 bp, Zea mays
cataaagtagcgcgtgcgcct

SEQ ID NO: 2074 - DNA, 21 bp, Zea mays
agggctgatttggtgactaga

SEQ ID NO: 2075 - DNA, 21 bp, Zea mays
agagctgccaggagtaagtat

SEQ ID NO: 2076 - DNA, 21 bp, Zea mays
ggaggcgtaggcgagggatta

SEQ ID NO: 2077 - DNA, 21 bp, Zea mays
cactatgtgttacctcggcgt

SEQ ID NO: 2078 - DNA, 21 bp, Zea mays
gttcgtttccgtcggattggg

SEQ ID NO: 2079 - DNA, 21 bp, Zea mays
gttgccgatgtacagttcgcc

SEQ ID NO: 2080 - DNA, 21 bp, Zea mays
gagaagccagtccacggtcgt

SEQ ID NO: 2081 - DNA, 21 bp, Zea mays
cacagcctatggcgccgagta

SEQ ID NO: 2082 - DNA, 21 bp, Zea mays
aaagcactcggcaaagccccg

SEQ ID NO: 2083 - DNA, 21 bp, Zea mays
gagaagccagtccacggtcgc

SEQ ID NO: 2084 - DNA, 21 bp, Zea mays
gactgagtgcagggcgactag

SEQ ID NO: 2085 - DNA, 21 bp, Zea mays
ttgcaacgcacgggcacccat

SEQ ID NO: 2086 - DNA, 21 bp, Zea mays
tcgcgaaccaaacggcaccta

SEQ ID NO: 2087 - DNA, 21 bp, Zea mays
cgagcactcggcaaagaaccg

SEQ ID NO: 2088 - DNA, 21 bp, Zea mays
cgtgcgttgctacggaatcaa

SEQ ID NO: 2089 - DNA, 21 bp, Zea mays
cctgtgcgacgttggcctgac

SEQ ID NO: 2090 - DNA, 21 bp, Zea mays
cgggcactcggcaaagatgga

SEQ ID NO: 2091 - DNA, 21 bp, Zea mays
cgtggtgcggtggatgcgggg

SEQ ID NO: 2092 - DNA, 21 bp, Zea mays
gataggtcccacccgcaggta

SEQ ID NO: 2093 - DNA, 21 bp, Zea mays
gggggtgtttggtttctgggg

SEQ ID NO: 2094 - DNA, 21 bp, Zea mays
cataggctatggcgctgaggt

SEQ ID NO: 2095 - DNA, 21 bp, Zea mays
gtcgacagtctatggatttgg

SEQ ID NO: 2096 - DNA, 21 bp, Zea mays
cgaaccgcctgtgatgtatta

SEQ ID NO: 2097 - DNA, 21 bp, Zea mays
gtgtcgtgcctgggccatgcg

SEQ ID NO: 2098 - DNA, 21 bp, Zea mays
agatgtctcacggcggcgctg

SEQ ID NO: 2099 - DNA, 21 bp, Zea mays
ccgcgatacggctgatcagca

SEQ ID NO: 2100 - DNA, 21 bp, Zea mays
cgggtcttcggctgcctcgtg

SEQ ID NO: 2101 - DNA, 21 bp, Zea mays
ctctccgcacaagactgcata

SEQ ID NO: 2102 - DNA, 21 bp, Zea mays
gtgaagatcgggcatcgtgat

SEQ ID NO: 2103 - DNA, 21 bp, Zea mays
cgggcactcggcaaagaattt

SEQ ID NO: 2104 - DNA, 21 bp, Zea mays
ccatagcctgtggcgccgagg

SEQ ID NO: 2105 - DNA, 21 bp, Zea mays
atatgcggacgccaaatctag

SEQ ID NO: 2106 - DNA, 21 bp, Zea mays
ggtaccgtcgaacttaacatt

SEQ ID NO: 2107 - DNA, 21 bp, Zea mays
gagcctgacgtaaggcccata

SEQ ID NO: 2108 - DNA, 21 bp, Zea mays
cccggggtcgaaacgccgaca

SEQ ID NO: 2109 - DNA, 21 bp, Zea mays
cctcgttcttggccctatcca

SEQ ID NO: 2110 - DNA, 21 bp, Zea mays
cctgcggcttctgtttgcgac

SEQ ID NO: 2111 - DNA, 21 bp, Zea mays
agtgccggcacgacacgacaa

SEQ ID NO: 2112 - DNA, 21 bp, Zea mays
ggttccagtggattgagcgcc

SEQ ID NO: 2113 - DNA, 21 bp, Zea mays
ggcaaagtgtgacaagttaga

SEQ ID NO: 2114 - DNA, 21 bp, Zea mays
ttgcaacgcacgggcactcaa

SEQ ID NO: 2115 - DNA, 21 bp, Zea mays
ctttgccgagtgccagatcac

SEQ ID NO: 2116 - DNA, 21 bp, Zea mays
gacctctggaagcagtcctac

SEQ ID NO: 2117 - DNA, 21 bp, Zea mays
cacctgccggaaaagtacgat

SEQ ID NO: 2118 - DNA, 21 bp, Zea mays
ctggcattgtgacgtgtggcg

SEQ ID NO: 2119 - DNA, 21 bp, Zea mays
ttgctccggcacgaggacata

SEQ ID NO: 2120 - DNA, 21 bp, Zea mays
gcgagccaggctgtggagaaa

SEQ ID NO: 2121 - DNA, 21 bp, Zea mays
gaacgtgacagcacatgcgac

SEQ ID NO: 2122 - DNA, 21 bp, Zea mays
gctgggtccagcgccaggatc

SEQ ID NO: 2123 - DNA, 21 bp, Zea mays
gtctcaaagacctcagacagc

SEQ ID NO: 2124 - DNA, 21 bp, Zea mays
cgagccagctcgcgagctaaa

SEQ ID NO: 2125 - DNA, 21 bp, Zea mays
gagtgtccgtgcgttacagtg

SEQ ID NO: 2126 - DNA, 21 bp, Zea mays
cgccggctgagggaggcgtcg

SEQ ID NO: 2127 - DNA, 21 bp, Zea mays
cccgtgacataagccagcagg

SEQ ID NO: 2128 - DNA, 21 bp, Zea mays
ccgcgctcggccggtcaggca

SEQ ID NO: 2129 - DNA, 21 bp, Zea mays
cccacttgttgcgggcgcacg

SEQ ID NO: 2130 - DNA, 21 bp, Zea mays
cgaagactcccggagctcggg

SEQ ID NO: 2131 - DNA, 21 bp, Zea mays
agggctgatttggtgacaagt

SEQ ID NO: 2132 - DNA, 21 bp, Zea mays
cgccataggctatggcgccga

SEQ ID NO: 2133 - DNA, 21 bp, Zea mays
gtaacactcggcaaagaagat

SEQ ID NO: 2134 - DNA, 21 bp, Zea mays
gtgaagccgtggtaacaccaa

SEQ ID NO: 2135 - DNA, 21 bp, Zea mays
gtcacactcggcaaagacttc

SEQ ID NO: 2136 - DNA, 21 bp, Zea mays
gttgcaacgcacggacaccca

SEQ ID NO: 2137 - DNA, 21 bp, Zea mays
agagcccaaaaaacccctcat

SEQ ID NO: 2138 - DNA, 21 bp, Zea mays
ctctttgccgagtgtctccct

SEQ ID NO: 2139 - DNA, 21 bp, Zea mays
cgggcactcggcaaagaaggc

SEQ ID NO: 2140 - DNA, 21 bp, Zea mays
ctggcactcggcaaaggaatc

SEQ ID NO: 2141 - DNA, 21 bp, Zea mays
ttctttgccgagtgccacgca

SEQ ID NO: 2142 - DNA, 21 bp, Zea mays
gtgctttgccgagtgtcagga

SEQ ID NO: 2143 - DNA, 21 bp, Zea mays
agccatctttgccgagtgctg

SEQ ID NO: 2144 - DNA, 21 bp, Zea mays
tgggctcgggcgaggcgtagt

SEQ ID NO: 2145 - DNA, 21 bp, Zea mays
ccagccagagcgcctgagtcg

SEQ ID NO: 2146 - DNA, 21 bp, Zea mays
agagtctccccgagccaaccc

SEQ ID NO: 2147 - DNA, 21 bp, Zea mays
tgaaccaaacaggcccttaag

SEQ ID NO: 2148 - DNA, 21 bp, Zea mays
agcaggggcaaaccaaacacc

SEQ ID NO: 2149 - DNA, 21 bp, Zea mays
cgttcctgagcaaccgaacaa

SEQ ID NO: 2150 - DNA, 21 bp, Zea mays
cgctcaggcggagacccaatg

SEQ ID NO: 2151 - DNA, 21 bp, Zea mays
ccacaaaccaaacaggcctta

SEQ ID NO: 2152 - DNA, 21 bp, Zea mays
tcgcgggtatgggtttgtctc

SEQ ID NO: 2153 - DNA, 21 bp, Zea mays
ggagtcggcggatgttgcgag

SEQ ID NO: 2154 - DNA, 21 bp, Zea mays
tcgtgatccattaccacacat

SEQ ID NO: 2155 - DNA, 21 bp, Zea mays
gaatcgctccatccacgaacg

SEQ ID NO: 2156 - DNA, 21 bp, Zea mays
caccaccaggaggagggaacg

SEQ ID NO: 2157 - DNA, 21 bp, Zea mays
gacactcggcaaagaagcccc

SEQ ID NO: 2158 - DNA, 21 bp, Zea mays
ctttgccgagtgccagatcgc

SEQ ID NO: 2159 - DNA, 21 bp, Zea mays
gtagcaacgcacgggcataca

SEQ ID NO: 2160 - DNA, 21 bp, Zea mays
cgcgtcagcacgcgactgtgg

SEQ ID NO: 2161 - DNA, 21 bp, Zea mays
agggctgatttggtgactggg

SEQ ID NO: 2162 - DNA, 21 bp, Zea mays
cactcggcaaagaacctatgc

SEQ ID NO: 2163 - DNA, 21 bp, Zea mays
tggcaggtccgcgcagttgct

SEQ ID NO: 2164 - DNA, 21 bp, Zea mays
actattggagttgctctaata

SEQ ID NO: 2165 - DNA, 21 bp, Zea mays
ggctttttacatcacagacgg

SEQ ID NO: 2166 - DNA, 21 bp, Zea mays
caaagtaggatgagtcggggc

SEQ ID NO: 2167 - DNA, 21 bp, Zea mays
caatccctggaccggcggtac

SEQ ID NO: 2168 - DNA, 21 bp, Zea mays
gttgtgctagtccggctgcac

SEQ ID NO: 2169 - DNA, 21 bp, Zea mays
cgctgactacagggctgccac

SEQ ID NO: 2170 - DNA, 21 bp, Zea mays
tccggtgaagtggtcgagggt

SEQ ID NO: 2171 - DNA, 21 bp, Zea mays
gaagtcgtcgtgctgcgtagc

SEQ ID NO: 2172 - DNA, 21 bp, Zea mays
gctcaggaggtagccccagat

SEQ ID NO: 2173 - DNA, 21 bp, Zea mays
aggagcagctcatgccggatc

SEQ ID NO: 2174 - DNA, 21 bp, Zea mays
gtgtcgtgcctgggccaccat

SEQ ID NO: 2175 - DNA, 21 bp, Zea mays
gtgtctatgacatgtggggca

SEQ ID NO: 2176 - DNA, 21 bp, Zea mays
ggtgcaagcatgcaatcgagc

SEQ ID NO: 2177 - DNA, 21 bp, Zea mays
gacggtcacggcgatgtgcgg

SEQ ID NO: 2178 - DNA, 21 bp, Zea mays
caatccagggagcttcggcat

SEQ ID NO: 2179 - DNA, 21 bp, Zea mays
tccgttgttggagatgccctc

SEQ ID NO: 2180 - DNA, 21 bp, Zea mays
ctctttgccgagtgtcttcca

SEQ ID NO: 2181 - DNA, 21 bp, Zea mays
gccctcggctcactggagtgg

SEQ ID NO: 2182 - DNA, 21 bp, Zea mays
ggccagagttatgcgctgggc

SEQ ID NO: 2183 - DNA, 21 bp, Zea mays
cgtctcgaccggagtctgcct

SEQ ID NO: 2184 - DNA, 21 bp, Zea mays
ttggtgtaaccgaacatgttt

SEQ ID NO: 2185 - DNA, 21 bp, Zea mays
agagctgccaggagtaagtac

SEQ ID NO: 2186 - DNA, 21 bp, Zea mays
tccgcgatatggttgatcggc

SEQ ID NO: 2187 - DNA, 21 bp, Zea mays
cgggaagagcatacctgcaga

SEQ ID NO: 2188 - DNA, 21 bp, Zea mays
caccctcgcgtgcgacactcc

SEQ ID NO: 2189 - DNA, 21 bp, Zea mays
gagcctgacgtaaggcctcgg

SEQ ID NO: 2190 - DNA, 21 bp, Zea mays
gagctgacgttgacgatgacc

SEQ ID NO: 2191 - DNA, 21 bp, Zea mays
agcgtcagcatgttgcgtcca

SEQ ID NO: 2192 - DNA, 21 bp, Zea mays
gggctgaacgggccgtgccta

SEQ ID NO: 2193 - DNA, 21 bp, Zea mays
gggttaggggttcgggtatat

SEQ ID NO: 2194 - DNA, 21 bp, Zea mays
gaagctgctgggtggcgtact

SEQ ID NO: 2195 - DNA, 21 bp, Zea mays
tgcccgtgcgttgcgacggca

SEQ ID NO: 2196 - DNA, 21 bp, Zea mays
tgccaggaggaggtctgcgcc

SEQ ID NO: 2197 - DNA, 21 bp, Zea mays
cgagacttcggatggccacga

SEQ ID NO: 2198 - DNA, 21 bp, Zea mays
gaactggaacaaagcggctct

SEQ ID NO: 2199 - DNA, 21 bp, Zea mays
attgcactcggcaaagacact

SEQ ID NO: 2200 - DNA, 21 bp, Zea mays
tgaaccaaacaggcccttaat

SEQ ID NO: 2201 - DNA, 21 bp, Zea mays
agcgtggactggcttctccgg

SEQ ID NO: 2202 - DNA, 21 bp, Zea mays
cggaaagttgatgagcagcca

SEQ ID NO: 2203 - DNA, 21 bp, Zea mays
gtcgaagcgaaactcgggcaa

SEQ ID NO: 2204 - DNA, 21 bp, Zea mays
cgggactgcagcaatgagggc

SEQ ID NO: 2205 - DNA, 21 bp, Zea mays
tccgaagccatctgccatgga

SEQ ID NO: 2206 - DNA, 21 bp, Zea mays
agaggactgtttagaggacga

SEQ ID NO: 2207 - DNA, 21 bp, Zea mays
ttgcaacgcacgggcacccac

SEQ ID NO: 2208 - DNA, 21 bp, Zea mays
cgagagggaggctgtgcactg

SEQ ID NO: 2209 - DNA, 21 bp, Zea mays
agactcagctagtgcttttgg

SEQ ID NO: 2210 - DNA, 21 bp, Zea mays
attgttaggctaactccagca

SEQ ID NO: 2211 - DNA, 21 bp, Zea mays
cggggattttctcggccggac

SEQ ID NO: 2212 - DNA, 21 bp, Zea mays
acagcactcggcaaagaagct

SEQ ID NO: 2213 - DNA, 21 bp, Zea mays
gaatcgtctgcttctcgcaac

SEQ ID NO: 2214 - DNA, 21 bp, Zea mays
cgggcactcggcaaagacgtt

SEQ ID NO: 2215 - DNA, 21 bp, Zea mays
ctgcatagatgggccggtctt

SEQ ID NO: 2216 - DNA, 21 bp, Zea mays
ggtacaaccgaacgggcccta

SEQ ID NO: 2217 - DNA, 21 bp, Zea mays
gagcctgacgtaaggcccacg

SEQ ID NO: 2218 - DNA, 21 bp, Zea mays
cccctccggttttgtggctcc

SEQ ID NO: 2219 - DNA, 21 bp, Zea mays
agctgaacgatcccttggggc

SEQ ID NO: 2220 - DNA, 21 bp, Zea mays
tcgcgctatctgccgggtttc

SEQ ID NO: 2221 - DNA, 21 bp, Zea mays
gcctactctctggccgacggg

SEQ ID NO: 2222 - DNA, 21 bp, Zea mays
ctccaaaatcgccgtccgcag

SEQ ID NO: 2223 - DNA, 21 bp, Zea mays
gtctttgccgagtgcttgtca

SEQ ID NO: 2224 - DNA, 21 bp, Zea mays
ctctttgccgagtgccacgca

SEQ ID NO: 2225 - DNA, 21 bp, Zea mays
gactgagtgcagggcgactgg

SEQ ID NO: 2226 - DNA, 21 bp, Zea mays
gccaatgatgatgacgccgag

SEQ ID NO: 2227 - DNA, 21 bp, Zea mays
ggcactcggcaaagaagtttc

SEQ ID NO: 2228 - DNA, 21 bp, Zea mays
ctctttgccgagtgtctagat

SEQ ID NO: 2229 - DNA, 21 bp, Zea mays
gcctcgtacagggccgtcgga

SEQ ID NO: 2230 - DNA, 21 bp, Zea mays
cggcgaagggtggggttggct

SEQ ID NO: 2231 - DNA, 21 bp, Zea mays
tgcccgtgcgttgcaacgggt

SEQ ID NO: 2232 - DNA, 21 bp, Zea mays
tgagctcgctcgactcgtagt

SEQ ID NO: 2233 - DNA, 21 bp, Zea mays
tcttttgactgcaaggacagc

SEQ ID NO: 2234 - DNA, 21 bp, Zea mays
ggtaccgtcgaacttaatgtg

SEQ ID NO: 2235 - DNA, 21 bp, Zea mays
ggccctagggcggttgaaccg

SEQ ID NO: 2236 - DNA, 21 bp, Zea mays
gaagctgctgggtggcgaacc

SEQ ID NO: 2237 - DNA, 21 bp, Zea mays
gtcagcagggtggacagacgg

SEQ ID NO: 2238 - DNA, 21 bp, Zea mays
gcaggctgttgatcgcttgga

SEQ ID NO: 2239 - DNA, 21 bp, Zea mays
cagcccagaaccggcacgacc

SEQ ID NO: 2240 - DNA, 21 bp, Zea mays
ctggcactcggcaaagggagc

SEQ ID NO: 2241 - DNA, 21 bp, Zea mays
acacaaacgaacaaggccatg

SEQ ID NO: 2242 - DNA, 21 bp, Zea mays
caggagtaagtaccgccggtc

SEQ ID NO: 2243 - DNA, 21 bp, Zea mays
tggtggtccggtggcgcaacc

SEQ ID NO: 2244 - DNA, 21 bp, Zea mays
gaggccgccaaggcggaaggt

SEQ ID NO: 2245 - DNA, 21 bp, Zea mays
gctgtccaccctgagtttcca

SEQ ID NO: 2246 - DNA, 21 bp, Zea mays
aggacttagggcgggtgcact

SEQ ID NO: 2247 - DNA, 21 bp, Zea mays
tgtgaggggctgcaaacattc

SEQ ID NO: 2248 - DNA, 21 bp, Zea mays
gccatagatcttggcgccaaa

SEQ ID NO: 2249 - DNA, 21 bp, Zea mays
gatggccaaacggcggtccgg

SEQ ID NO: 2250 - DNA, 21 bp, Zea mays
gcatactgcagtaccgtgcgg

SEQ ID NO: 2251 - DNA, 21 bp, Zea mays
ctctggcactcggcaaagtag

SEQ ID NO: 2252 - DNA, 21 bp, Zea mays
ctctttgccgagtgtctactg

SEQ ID NO: 2253 - DNA, 21 bp, Zea mays
agtccctagaaaccaaacgta

SEQ ID NO: 2254 - DNA, 21 bp, Zea mays
cgaattcggaagctcgaccta

SEQ ID NO: 2255 - DNA, 21 bp, Zea mays
ccagctggatgacactcggca

SEQ ID NO: 2256 - DNA, 21 bp, Zea mays
cataaagtagcgcgtgcatct

SEQ ID NO: 2257 - DNA, 21 bp, Zea mays
ttgcacgacggagagtgtggg

SEQ ID NO: 2258 - DNA, 21 bp, Zea mays
ctggtgtcggacgaatacgga

SEQ ID NO: 2259 - DNA, 21 bp, Zea mays
cactcggcaaagaacctatat

SEQ ID NO: 2260 - DNA, 21 bp, Zea mays
ctcgtcggccgacctcgccac

SEQ ID NO: 2261 - DNA, 21 bp, Zea mays
ggaggagcgtcgacgagggca

SEQ ID NO: 2262 - DNA, 21 bp, Zea mays
cgcgtgaggggcctgttcagg

SEQ ID NO: 2263 - DNA, 21 bp, Zea mays
tgcgcggttgtggtgggaggg

SEQ ID NO: 2264 - DNA, 21 bp, Zea mays
cgctcaggcggagacccgctg

SEQ ID NO: 2265 - DNA, 21 bp, Zea mays
tgtcgtaggaagttagcgcct

SEQ ID NO: 2266 - DNA, 21 bp, Zea mays
ggcactcggcaaagaaggtcc

SEQ ID NO: 2267 - DNA, 21 bp, Zea mays
gtctccgggttaagcttccgt

SEQ ID NO: 2268 - DNA, 21 bp, Zea mays
gacaaccactacgatgagctc

SEQ ID NO: 2269 - DNA, 21 bp, Zea mays
ccgatggcatactggcgaagc

SEQ ID NO: 2270 - DNA, 21 bp, Zea mays
tgtgactgcgtcgagctccac

SEQ ID NO: 2271 - DNA, 21 bp, Zea mays
ctcgtcggcggcgaggagtcc

SEQ ID NO: 2272 - DNA, 21 bp, Zea mays
ggcccaggcacggcactagcc

SEQ ID NO: 2273 - DNA, 21 bp, Zea mays
gatggcggggattcctgagat

SEQ ID NO: 2274 - DNA, 21 bp, Zea mays
tggtgcacggttctgccgagg

SEQ ID NO: 2275 - DNA, 21 bp, Zea mays
gatggcgctgaagcgcgcgac

SEQ ID NO: 2276 - DNA, 21 bp, Zea mays
ggctgcgttggtaatcgactg

SEQ ID NO: 2277 - DNA, 21 bp, Zea mays
gaatcgtctgcttctcgcagc

SEQ ID NO: 2278 - DNA, 21 bp, Zea mays
cgtggaccgagcgattccgac

SEQ ID NO: 2279 - DNA, 21 bp, Zea mays
cgttgcaacgcatgagcactc

SEQ ID NO: 2280 - DNA, 21 bp, Zea mays
tccggtgaagtggtcgaggcg

SEQ ID NO: 2281 - DNA, 21 bp, Zea mays
gggggtgtttggtttctacgg

SEQ ID NO: 2282 - DNA, 21 bp, Zea mays
agcactcggcaaagaaagaac

SEQ ID NO: 2283 - DNA, 21 bp, Zea mays
cgggccagcccggcacgatcg

SEQ ID NO: 2284 - DNA, 21 bp, Zea mays
accgtccagaagaaacagtca

SEQ ID NO: 2285 - DNA, 21 bp, Zea mays
ccgagggaattcagcgaaggg

SEQ ID NO: 2286 - DNA, 21 bp, Zea mays
ctctttgccgagtgtctacca

SEQ ID NO: 2287 - DNA, 21 bp, Zea mays
gtcgaagtcagtgctggacct

SEQ ID NO: 2288 - DNA, 21 bp, Zea mays
gagcaggttagcgcgagcttt

SEQ ID NO: 2289 - DNA, 21 bp, Zea mays
accaacgacctccgggcagaa

SEQ ID NO: 2290 - DNA, 21 bp, Zea mays
gctcttcttcgacggatctgc

SEQ ID NO: 2291 - DNA, 21 bp, Zea mays
aaggtccaggacctccacagg

SEQ ID NO: 2292 - DNA, 21 bp, Zea mays
tgactgtggcagactggcttg

SEQ ID NO: 2293 - DNA, 21 bp, Zea mays
ccgcccctgccactgcgcata

SEQ ID NO: 2294 - DNA, 21 bp, Zea mays
gggttaggggttcgggtactg

SEQ ID NO: 2295 - DNA, 21 bp, Zea mays
gccatagactatggcgccgag

SEQ ID NO: 2296 - DNA, 21 bp, Zea mays
ccgcgatacggctgatcggcg

SEQ ID NO: 2297 - DNA, 21 bp, Zea mays
aaggcactcggcaaagatggg

SEQ ID NO: 2298 - DNA, 21 bp, Zea mays
gacactcggcaaagaaggaaa

SEQ ID NO: 2299 - DNA, 21 bp, Zea mays
aggggacgctgctggagacag

SEQ ID NO: 2300 - DNA, 21 bp, Zea mays
acccgacagcctgtttgggcg

SEQ ID NO: 2301 - DNA, 21 bp, Zea mays
tgttttatttcgggcactcgg

SEQ ID NO: 2302 - DNA, 21 bp, Zea mays
ttcgtcgtctgcggggtggag

SEQ ID NO: 2303 - DNA, 21 bp, Zea mays
caacggaggagggttgaggcc

SEQ ID NO: 2304 - DNA, 21 bp, Zea mays
ctttgccgagtgccagatcag

SEQ ID NO: 2305 - DNA, 21 bp, Zea mays
cgcctgagcggggagcaggag

SEQ ID NO: 2306 - DNA, 21 bp, Zea mays
actattggagttgctctaagg

SEQ ID NO: 2307 - DNA, 21 bp, Zea mays
gtgacactcgacaaagaggtt

SEQ ID NO: 2308 - DNA, 21 bp, Zea mays
cggaccgtccgagtatgtcac

SEQ ID NO: 2309 - DNA, 21 bp, Zea mays
agcctttgccgagtgtcatcg

SEQ ID NO: 2310 - DNA, 21 bp, Zea mays
gtgcccgtgcgttgcgacggc

SEQ ID NO: 2311 - DNA, 21 bp, Zea mays
acgacggtcagtcggcgagct

SEQ ID NO: 2312 - DNA, 21 bp, Zea mays
gtcgtctgggcagggcgtaac

SEQ ID NO: 2313 - DNA, 21 bp, Zea mays
ctctttgccgagtgccaaata

SEQ ID NO: 2314 - DNA, 21 bp, Zea mays
gctctggatggtttgattgca

SEQ ID NO: 2315 - DNA, 21 bp, Zea mays
ttagccacgaaccaaacatat

SEQ ID NO: 2316 - DNA, 21 bp, Zea mays
ctgaccacgaatcaagcaaac

SEQ ID NO: 2317 - DNA, 21 bp, Zea mays
cactcggcaaagaacctcttt

SEQ ID NO: 2318 - DNA, 21 bp, Zea mays
ccacacctgcacaccacaagc

SEQ ID NO: 2319 - DNA, 21 bp, Zea mays
ccgctaacttcctacggcaga

SEQ ID NO: 2320 - DNA, 21 bp, Zea mays
ctaccccgacgatggcgagtg

SEQ ID NO: 2321 - DNA, 21 bp, Zea mays
ggacggtcgagtgggatgttg

SEQ ID NO: 2322 - DNA, 21 bp, Zea mays
aaggcctccagagcggtggac

SEQ ID NO: 2323 - DNA, 21 bp, Zea mays
cgcgaagctaccgtgtgcccg

SEQ ID NO: 2324 - DNA, 21 bp, Zea mays
ccagcggggtgctggttggcg

SEQ ID NO: 2325 - DNA, 21 bp, Zea mays
ggacataagccttcggccgtc

SEQ ID NO: 2326 - DNA, 21 bp, Zea mays
cgtggtgcggtggatgcggag

SEQ ID NO: 2327 - DNA, 21 bp, Zea mays
tttcctgggagcctggctgct

SEQ ID NO: 2328 - DNA, 21 bp, Zea mays
gtcgcaacgcacgggcatgta

SEQ ID NO: 2329 - DNA, 21 bp, Zea mays
aggcaaaccagagacgctagc

SEQ ID NO: 2330 - DNA, 21 bp, Zea mays
caaaggctttgccgagtgtaa

SEQ ID NO: 2331 - DNA, 21 bp, Zea mays
tccggtgaagtggtcgagggc

SEQ ID NO: 2332 - DNA, 21 bp, Zea mays
tgtgacactcgacaaagaagt

SEQ ID NO: 2333 - DNA, 21 bp, Zea mays
cggaaagttgatgagcagaca

SEQ ID NO: 2334 - DNA, 21 bp, Zea mays
ttagccacgaaccaaacatag

SEQ ID NO: 2335 - DNA, 21 bp, Zea mays
gccataggctgtggcgctaaa

SEQ ID NO: 2336 - DNA, 21 bp, Zea mays
cacagcctatggcgccgagca

SEQ ID NO: 2337 - DNA, 21 bp, Zea mays
gagccacaaaaccggaggagg

SEQ ID NO: 2338 - DNA, 21 bp, Zea mays
cctccggttttgtggctccca

SEQ ID NO: 2339 - DNA, 21 bp, Zea mays
ctctttgccgagtgccatatt

SEQ ID NO: 2340 - DNA, 21 bp, Zea mays
cagagacttggtcgtccgctc

SEQ ID NO: 2341 - DNA, 21 bp, Zea mays
atcattggcgggtggctgagc

SEQ ID NO: 2342 - DNA, 21 bp, Zea mays
ggacgcaatcggacggtcgag

SEQ ID NO: 2343 - DNA, 21 bp, Zea mays
ccgtgccgtgcttgggccggg

SEQ ID NO: 2344 - DNA, 21 bp, Zea mays
ggcactaaaaagcacggccag

SEQ ID NO: 2345 - DNA, 21 bp, Zea mays
caatcccctccggttttatgg

SEQ ID NO: 2346 - DNA, 21 bp, Zea mays
cgcgtccgcggcgtgtggcgt

SEQ ID NO: 2347 - DNA, 21 bp, Zea mays
aaagtcaaacgcttgatatga

SEQ ID NO: 2348 - DNA, 21 bp, Zea mays
gagcttgactctagtccgcct

SEQ ID NO: 2349 - DNA, 21 bp, Zea mays
gtggcggacccagaaattggc

SEQ ID NO: 2350 - DNA, 21 bp, Zea mays
acccccccccccccccccaaa

SEQ ID NO: 2351 - DNA, 21 bp, Zea mays
atcattggcgggtggctgggc

SEQ ID NO: 2352 - DNA, 21 bp, Zea mays
gagtgggaagcagaccggtgc

SEQ ID NO: 2353 - DNA, 21 bp, Zea mays
atagagaatgcacccaggccg

SEQ ID NO: 2354 - DNA, 21 bp, Zea mays
actcgtgcgttgcaacgggaa

SEQ ID NO: 2355 - DNA, 21 bp, Zea mays
gagaagaaggctcaagcaaat

SEQ ID NO: 2356 - DNA, 21 bp, Zea mays
catgtgtctgggaagcggtgt

SEQ ID NO: 2357 - DNA, 21 bp, Zea mays
caatcccctccggtttttgga

SEQ ID NO: 2358 - DNA, 21 bp, Zea mays
gccatagatcttggcgcctac

SEQ ID NO: 2359 - DNA, 21 bp, Zea mays
tgtgacactcgacaaagagag

SEQ ID NO: 2360 - DNA, 21 bp, Zea mays
ttgctgggttgctcgacgggc

SEQ ID NO: 2361 - DNA, 21 bp, Zea mays
gaatgagctttgcggggagga

SEQ ID NO: 2362 - DNA, 21 bp, Zea mays
agggtctgtttggttcgctac

SEQ ID NO: 2363 - DNA, 21 bp, Zea mays
gccaagatctgtggcgccaag

SEQ ID NO: 2364 - DNA, 21 bp, Zea mays
ccacagatcttggcgccgaga

SEQ ID NO: 2365 - DNA, 21 bp, Zea mays
gcaccaagatctgtggcaccg

SEQ ID NO: 2366 - DNA, 21 bp, Zea mays
tttttgacactcggcaaagta

SEQ ID NO: 2367 - DNA, 21 bp, Zea mays
gagtgtccgtgcgttacagac

SEQ ID NO: 2368 - DNA, 21 bp, Zea mays
agggctgatttggtgactcgg

SEQ ID NO: 2369 - DNA, 21 bp, Zea mays
acgggctggcccgacacagtc

SEQ ID NO: 2370 - DNA, 21 bp, Zea mays
aaaaagcactcggcaaagagc

SEQ ID NO: 2371 - DNA, 21 bp, Zea mays
gtgcttagtccggctgcaccc

SEQ ID NO: 2372 - DNA, 21 bp, Zea mays
actgacaggcgatgtgccgcc

SEQ ID NO: 2373 - DNA, 21 bp, Zea mays
gaccgcaactgctgctatcac

SEQ ID NO: 2374 - DNA, 21 bp, Zea mays
cgtggtcgtgcgcgctttccg

SEQ ID NO: 2375 - DNA, 21 bp, Zea mays
agggcccgttcggttgacagg

SEQ ID NO: 2376 - DNA, 21 bp, Zea mays
ggcggtcacgtcgaggtacga

SEQ ID NO: 2377 - DNA, 21 bp, Zea mays
ggcagacagcaaggactgcgg

SEQ ID NO: 2378 - DNA, 21 bp, Zea mays
gaaccaaacaggcccatatac

SEQ ID NO: 2379 - DNA, 21 bp, Zea mays
cactcgatcctaggctggctg

SEQ ID NO: 2380 - DNA, 21 bp, Zea mays
cttccgcaggagaggacagga

SEQ ID NO: 2381 - DNA, 21 bp, Zea mays
gaaggttttgccgagtgtcaa

SEQ ID NO: 2382 - DNA, 21 bp, Zea mays
agggctgatttggtgacaagg

SEQ ID NO: 2383 - DNA, 21 bp, Zea mays
tatgggtccgcccctgcctgg

SEQ ID NO: 2384 - DNA, 21 bp, Zea mays
gagtgtccgtgcgttacaggc

SEQ ID NO: 2385 - DNA, 21 bp, Zea mays
ggcactcggcaaagaagcaaa

SEQ ID NO: 2386 - DNA, 21 bp, Zea mays
gtactctatgagccggcgatg

SEQ ID NO: 2387 - DNA, 21 bp, Zea mays
cccacttgttgcgggcgcagg

SEQ ID NO: 2388 - DNA, 21 bp, Zea mays
ctggtctagaactgtttccgg

SEQ ID NO: 2389 - DNA, 21 bp, Zea mays
tgtgacactcgacaaagagtc

SEQ ID NO: 2390 - DNA, 21 bp, Zea mays
gacactcggcaaagaagcaag

SEQ ID NO: 2391 - DNA, 21 bp, Zea mays
taggtggatgcccgtgcgttg

SEQ ID NO: 2392 - DNA, 21 bp, Zea mays
aaccgaacaaggccttaaaga

SEQ ID NO: 2393 - DNA, 21 bp, Zea mays
agcgtcagcatgttgcgtccg

SEQ ID NO: 2394 - DNA, 21 bp, Zea mays
tccctccctccctccctcctt

SEQ ID NO: 2395 - DNA, 21 bp, Zea mays
ttgctccggcacgaggaccta

SEQ ID NO: 2396 - DNA, 21 bp, Zea mays
agtcctctcgtgcaaatcggc

SEQ ID NO: 2397 - DNA, 21 bp, Zea mays
agcaggaggcagagcaggcag

SEQ ID NO: 2398 - DNA, 21 bp, Zea mays
cgggcactcggcaaagaagtt

SEQ ID NO: 2399 - DNA, 21 bp, Zea mays
agtcatgaaccaaacaagccc

SEQ ID NO: 2400 - DNA, 21 bp, Zea mays
cgaagcccatgtgagaacgac

SEQ ID NO: 2401 - DNA, 21 bp, Zea mays
aaacattttagtttgcagtcg

SEQ ID NO: 2402 - DNA, 21 bp, Zea mays
ttgctcggaggacctgttggt

SEQ ID NO: 2403 - DNA, 21 bp, Zea mays
acacgcagtggcggagcaccc

SEQ ID NO: 2404 - DNA, 21 bp, Zea mays
gagccacaaaaccggagggaa

SEQ ID NO: 2405 - DNA, 21 bp, Zea mays
cctccggttttgtggctcaca

SEQ ID NO: 2406 - DNA, 21 bp, Zea mays
gctcaggaggtagccccggat

SEQ ID NO: 2407 - DNA, 21 bp, Zea mays
tcggctcgactcggctcgtga

SEQ ID NO: 2408 - DNA, 21 bp, Zea mays
ggctgcgttggtaatcgaccg

SEQ ID NO: 2409 - DNA, 21 bp, Zea mays
aggatctgtccgattgcccca

SEQ ID NO: 2410 - DNA, 21 bp, Zea mays
ctggcactcggcaaagtctgt

SEQ ID NO: 2411 - DNA, 21 bp, Zea mays
gactgagtgcagggcgaccgg

SEQ ID NO: 2412 - DNA, 21 bp, Zea mays
cgagttgtgatgtggtgagcc

SEQ ID NO: 2413 - DNA, 21 bp, Zea mays
ttccaggagtgctccaggtcc

SEQ ID NO: 2414 - DNA, 21 bp, Zea mays
cgctcaggcggagacccgatg

SEQ ID NO: 2415 - DNA, 21 bp, Zea mays
gaatgaacccatgatgcacca

SEQ ID NO: 2416 - DNA, 21 bp, Zea mays
ccaattccccgtggatcagcc

SEQ ID NO: 2417 - DNA, 21 bp, Zea mays
tggtcagctcggctcggatca

SEQ ID NO: 2418 - DNA, 21 bp, Zea mays
gaggcgtcctcagcgacggac

SEQ ID NO: 2419 - DNA, 21 bp, Zea mays
ggttggactgtcgagtgggac

SEQ ID NO: 2420 - DNA, 21 bp, Zea mays
gccgagtggctgctgtactag

SEQ ID NO: 2421 - DNA, 21 bp, Zea mays
aagggctgatttggtgatcca

SEQ ID NO: 2422 - DNA, 21 bp, Zea mays
agggactgcactgcgtaaacc

SEQ ID NO: 2423 - DNA, 21 bp, Zea mays
cgtctccgcttgggtcggctc

SEQ ID NO: 2424 - DNA, 21 bp, Zea mays
gtgacgctagcgctgcaggcc

SEQ ID NO: 2425 - DNA, 21 bp, Zea mays
agggctgatttggtgaccgga

SEQ ID NO: 2426 - DNA, 21 bp, Zea mays
cctggtcctgacgtcccgact

SEQ ID NO: 2427 - DNA, 21 bp, Zea mays
agagctgccaggagtaagtgc

SEQ ID NO: 2428 - DNA, 21 bp, Zea mays
ggcgcatggctgggcgttggg

SEQ ID NO: 2429 - DNA, 21 bp, Zea mays
cgagactgcgagggctcaggt

SEQ ID NO: 2430 - DNA, 21 bp, Zea mays
cgtgccgaggacggaaggcca

SEQ ID NO: 2431 - DNA, 21 bp, Zea mays
cgccataggctatggcgtcga

SEQ ID NO: 2432 - DNA, 21 bp, Zea mays
caccggacgcaccgattttcg

SEQ ID NO: 2433 - DNA, 21 bp, Zea mays
tccgacccgttgcgatcgagg

SEQ ID NO: 2434 - DNA, 21 bp, Zea mays
cccacttgttgcgggcgtagg

SEQ ID NO: 2435 - DNA, 21 bp, Zea mays
ctggtgcgggtgcctctcgga

SEQ ID NO: 2436 - DNA, 21 bp, Zea mays
gccaaacactcgacgaacgac

SEQ ID NO: 2437 - DNA, 21 bp, Zea mays
gtcgcaacgcacgggcactca

SEQ ID NO: 2438 - DNA, 21 bp, Zea mays
ctggaccgcttgtcttcccca

SEQ ID NO: 2439 - DNA, 21 bp, Zea mays
caactcagctagaggcccttt

SEQ ID NO: 2440 - DNA, 21 bp, Zea mays
acaaaccaaacaagcccttat

SEQ ID NO: 2441 - DNA, 21 bp, Zea mays
cacagtgcggcacaaagctaa

SEQ ID NO: 2442 - DNA, 21 bp, Zea mays
tgggtcggaagcggggcaccg

SEQ ID NO: 2443 - DNA, 21 bp, Zea mays
gtgatgtcccaggcggttcgg

SEQ ID NO: 2444 - DNA, 21 bp, Zea mays
gggtgctgagccccgacatgc

SEQ ID NO: 2445 - DNA, 21 bp, Zea mays
cttttcgggcttgggccgggc

SEQ ID NO: 2446 - DNA, 21 bp, Zea mays
tcgtgatccattaccacctct

SEQ ID NO: 2447 - DNA, 21 bp, Zea mays
catgtgtctgggaagcggtgc

SEQ ID NO: 2448 - DNA, 21 bp, Zea mays
tggagtggaccgtgttgccgg

SEQ ID NO: 2449 - DNA, 21 bp, Zea mays
caggcactcggcaaagaagcc

SEQ ID NO: 2450 - DNA, 21 bp, Zea mays
agccttctttgccgagtgcct

SEQ ID NO: 2451 - DNA, 21 bp, Zea mays
ccctacagcgcctcctacgta

SEQ ID NO: 2452 - DNA, 21 bp, Zea mays
cgtggaccgagcgattctggc

SEQ ID NO: 2453 - DNA, 21 bp, Zea mays
gaaccaaacaggccctatatg

SEQ ID NO: 2454 - DNA, 21 bp, Zea mays
aggtgagtgcccgtgcgttgt

SEQ ID NO: 2455 - DNA, 21 bp, Zea mays
ggacggtcgagtgggatgctg

SEQ ID NO: 2456 - DNA, 21 bp, Zea mays
ctttgccgagtgccagatcgg

SEQ ID NO: 2457 - DNA, 21 bp, Zea mays
agccggctgcaaaccagaatg

SEQ ID NO: 2458 - DNA, 21 bp, Zea mays
gaacgacgacgagatcgagtc

SEQ ID NO: 2459 - DNA, 21 bp, Zea mays
tgatcagccgccgcccgctcc

SEQ ID NO: 2460 - DNA, 21 bp, Zea mays
cgagccctctttgccgagtgc

SEQ ID NO: 2461 - DNA, 21 bp, Zea mays
aagggctgatttggtgatcgg

SEQ ID NO: 2462 - DNA, 21 bp, Zea mays
aaaaagcactcggcaaagaaa

SEQ ID NO: 2463 - DNA, 21 bp, Zea mays
cgagttgtgatgtggtgagct

SEQ ID NO: 2464 - DNA, 21 bp, Zea mays
tggcccagagtagtcgcacga

SEQ ID NO: 2465 - DNA, 21 bp, Zea mays
gaggttgtcgatgttccagga

SEQ ID NO: 2466 - DNA, 21 bp, Zea mays
tgggcagcatccgacggacga

SEQ ID NO: 2467 - DNA, 21 bp, Zea mays
aggctggaggctagcaggacg

SEQ ID NO: 2468 - DNA, 21 bp, Zea mays
cactatttcgctctccagcag

SEQ ID NO: 2469 - DNA, 21 bp, Zea mays
gttcccgttgcaacgcacggg

SEQ ID NO: 2470 - DNA, 21 bp, Zea mays
aggccatgagggactccctgt

SEQ ID NO: 2471 - DNA, 21 bp, Zea mays
ccggcccggtggcactatggc

SEQ ID NO: 2472 - DNA, 21 bp, Zea mays
cgttaggtgcaagcgtgtaag

SEQ ID NO: 2473 - DNA, 21 bp, Zea mays
cgggcactcggcaaagagctc

SEQ ID NO: 2474 - DNA, 21 bp, Zea mays
aggcgggggcagtctacaata

SEQ ID NO: 2475 - DNA, 21 bp, Zea mays
cggtggttgcggtggcggcgg

SEQ ID NO: 2476 - DNA, 21 bp, Zea mays
gctgatcaggctgcgttggta

SEQ ID NO: 2477 - DNA, 21 bp, Zea mays
ccctaatcaccaaatcagtcc

SEQ ID NO: 2478 - DNA, 21 bp, Zea mays
gtgacacagttagccacgaat

SEQ ID NO: 2479 - DNA, 21 bp, Zea mays
cgaacgcagcggtaccctcga

SEQ ID NO: 2480 - DNA, 21 bp, Zea mays
gaagttggctcgtccacgtcg

SEQ ID NO: 2481 - DNA, 21 bp, Zea mays
taggtgtacatttgggtcggg

SEQ ID NO: 2482 - DNA, 21 bp, Zea mays
ccgcgacctggttggcgatct

SEQ ID NO: 2483 - DNA, 21 bp, Zea mays
gcgtgttgtggcccatgaccc

SEQ ID NO: 2484 - DNA, 21 bp, Zea mays
gagccacaaaaccggaggaaa

SEQ ID NO: 2485 - DNA, 21 bp, Zea mays
cctccggttttgtggctctaa

SEQ ID NO: 2486 - DNA, 21 bp, Zea mays
caatcccctccggtttttggc

SEQ ID NO: 2487 - DNA, 21 bp, Zea mays
ccgtgccgtgcttgggccgat

SEQ ID NO: 2488 - DNA, 21 bp, Zea mays
ttggtgtaaccgaacaagccc

SEQ ID NO: 2489 - DNA, 21 bp, Zea mays
gaaccaaacaggccctaggta

SEQ ID NO: 2490 - DNA, 21 bp, Zea mays
aaccttgtccgcgtgagcgac

SEQ ID NO: 2491 - DNA, 21 bp, Zea mays
caagatgcagttggtggacaa

SEQ ID NO: 2492 - DNA, 21 bp, Zea mays
cactcggcaaagaacctatac

SEQ ID NO: 2493 - DNA, 21 bp, Zea mays
tggcccaggcacggcacgcaa

SEQ ID NO: 2494 - DNA, 21 bp, Zea mays
gtgccgtgcctgggccagcaa

SEQ ID NO: 2495 - DNA, 21 bp, Zea mays
agcactcggcaaagaaagtac

SEQ ID NO: 2496 - DNA, 21 bp, Zea mays
ggcgtcgtcgtcggatgctgg

SEQ ID NO: 2497 - DNA, 21 bp, Zea mays
agagtgactccacaaaccaaa

SEQ ID NO: 2498 - DNA, 21 bp, Zea mays
cgggccagcccggcacggatg

SEQ ID NO: 2499 - DNA, 21 bp, Zea mays
actcggcaaagcctcggattt

SEQ ID NO: 2500 - DNA, 21 bp, Zea mays
cgttggctctcggcaaagagg

SEQ ID NO: 2501 - DNA, 21 bp, Zea mays
gccatagactatggcgctgag

SEQ ID NO: 2502 - DNA, 21 bp, Zea mays
cagtttcaacggtcgtctcgc

SEQ ID NO: 2503 - DNA, 21 bp, Zea mays
gggggagcgacaactgccgtc

SEQ ID NO: 2504 - DNA, 21 bp, Zea mays
gagcggggagcgtagggcaaa

SEQ ID NO: 2505 - DNA, 21 bp, Zea mays
tgcccgtgcgttgcaacaaca

SEQ ID NO: 2506 - DNA, 21 bp, Zea mays
acggctgtctgcgctatgcgg

SEQ ID NO: 2507 - DNA, 21 bp, Zea mays
gagccacaaaaccggagcaga

SEQ ID NO: 2508 - DNA, 21 bp, Zea mays
gtaggtgcccgtgcgttgcca

SEQ ID NO: 2509 - DNA, 21 bp, Zea mays
agtgtgacactcggcaaagaa

SEQ ID NO: 2510 - DNA, 21 bp, Zea mays
gtagcaacgcacgggcattca

SEQ ID NO: 2511 - DNA, 21 bp, Zea mays
gtgctttgccgagtgtcaggg

SEQ ID NO: 2512 - DNA, 21 bp, Zea mays
gttttcttagtgggctgggcc

SEQ ID NO: 2513 - DNA, 21 bp, Zea mays
gtcgcaacgcacgggcaccta

SEQ ID NO: 2514 - DNA, 21 bp, Zea mays
ccgtgccacggacggtccaga

SEQ ID NO: 2515 - DNA, 21 bp, Zea mays
gactgagtgcagggcgacctt

SEQ ID NO: 2516 - DNA, 21 bp, Zea mays
gggcggagtctgacgtaaggc

SEQ ID NO: 2517 - DNA, 21 bp, Zea mays
cgtggcgtcgacgtggcctcg

SEQ ID NO: 2518 - DNA, 21 bp, Zea mays
ggttgctgggataacttggtc

SEQ ID NO: 2519 - DNA, 21 bp, Zea mays
gggggtgtttggtttctaaac

SEQ ID NO: 2520 - DNA, 21 bp, Zea mays
tgcgtgaccggccgagcgcgg

SEQ ID NO: 2521 - DNA, 21 bp, Zea mays
taggcgaagtcgtgcgtgcat

SEQ ID NO: 2522 - DNA, 21 bp, Zea mays
gtagcggttgcgtgcgcaggc

SEQ ID NO: 2523 - DNA, 21 bp, Zea mays
catgggtaagccgatcctagg

SEQ ID NO: 2524 - DNA, 21 bp, Zea mays
cggcgaagggtggggttagct

SEQ ID NO: 2525 - DNA, 21 bp, Zea mays
gcacccaacaacctgcttcag

SEQ ID NO: 2526 - DNA, 21 bp, Zea mays
ctggttgtgggttgggccagg

SEQ ID NO: 2527 - DNA, 21 bp, Zea mays
cgagtgtcggttgatctgagc

SEQ ID NO: 2528 - DNA, 21 bp, Zea mays
tggcccagagtagtcgcccga

SEQ ID NO: 2529 - DNA, 21 bp, Zea mays
tcgtgtcggaccgtgctttga

SEQ ID NO: 2530 - DNA, 21 bp, Zea mays
cagagcgaagctgaggcgagc

SEQ ID NO: 2531 - DNA, 21 bp, Zea mays
tcgtatctggtgagcctggct

SEQ ID NO: 2532 - DNA, 21 bp, Zea mays
gacgacttcgtacggcgggca

SEQ ID NO: 2533 - DNA, 21 bp, Zea mays
ggtgacgctcccgaagcggac

SEQ ID NO: 2534 - DNA, 21 bp, Zea mays
aagggctgatttggtgactgg

SEQ ID NO: 2535 - DNA, 21 bp, Zea mays
cttcggctctgcgccatcctt

SEQ ID NO: 2536 - DNA, 21 bp, Zea mays
gctggccgtgggcttgacttg

SEQ ID NO: 2537 - DNA, 21 bp, Zea mays
ttctttgccgagtgccagctt

SEQ ID NO: 2538 - DNA, 21 bp, Zea mays
gaggacaaagtgcgcactaaa

SEQ ID NO: 2539 - DNA, 21 bp, Zea mays
tggtacggcgtggcacaacga

SEQ ID NO: 2540 - DNA, 21 bp, Zea mays
accacgtaccgaccaggtgcg

SEQ ID NO: 2541 - DNA, 21 bp, Zea mays
ttctttgccgagtgccatggt

SEQ ID NO: 2542 - DNA, 21 bp, Zea mays
taggctctagggttcttgaga

SEQ ID NO: 2543 - DNA, 21 bp, Zea mays
gcctcgctgggttgctcggtg

SEQ ID NO: 2544 - DNA, 21 bp, Zea mays
caagatgcagttggtggatga

SEQ ID NO: 2545 - DNA, 21 bp, Zea mays
ccaacggtgctgcgtcagggg

SEQ ID NO: 2546 - DNA, 21 bp, Zea mays
gactctcaacgaaagcagttt

SEQ ID NO: 2547 - DNA, 21 bp, Zea mays
gacactcggcaaagaagcacg

SEQ ID NO: 2548 - DNA, 21 bp, Zea mays
ggtgacactcggcaaaggcgc

SEQ ID NO: 2549 - DNA, 21 bp, Zea mays
gcttgcagcgattgagcctag

SEQ ID NO: 2550 - DNA, 21 bp, Zea mays
gaaccaggttgcagggatggt

SEQ ID NO: 2551 - DNA, 21 bp, Zea mays
cgagacttcggatggccgcga

SEQ ID NO: 2552 - DNA, 21 bp, Zea mays
cggcggctttgccgagtgctt

SEQ ID NO: 2553 - DNA, 21 bp, Zea mays
ggcactcggcaaagaagctct

SEQ ID NO: 2554 - DNA, 21 bp, Zea mays
gcctcgctgggttgctcaacg

SEQ ID NO: 2555 - DNA, 21 bp, Zea mays
cgtaccgaccaggtgcgcaga

SEQ ID NO: 2556 - DNA, 21 bp, Zea mays
aagctgaggcgtgctgcgtat

SEQ ID NO: 2557 - DNA, 21 bp, Zea mays
gagcggggagcgtagggcaag

SEQ ID NO: 2558 - DNA, 21 bp, Zea mays
cacccgttttgctgcgctctc

SEQ ID NO: 2559 - DNA, 21 bp, Zea mays
cggcggctttgccgagtgtcc

SEQ ID NO: 2560 - DNA, 21 bp, Zea mays
gacactcggcaaagaagtctc

SEQ ID NO: 2561 - DNA, 21 bp, Zea mays
ctcggcaaaggctcggattcc

SEQ ID NO: 2562 - DNA, 21 bp, Zea mays
gagccgagccgagctgacctc

SEQ ID NO: 2563 - DNA, 21 bp, Zea mays
ggaccaaggtccgatctacca

SEQ ID NO: 2564 - DNA, 21 bp, Zea mays
tccggtgaagtggtcgacgac

SEQ ID NO: 2565 - DNA, 21 bp, Zea mays
ggggacgggtttggggagcta

SEQ ID NO: 2566 - DNA, 21 bp, Zea mays
gtcaaaacaggtggtggactt

SEQ ID NO: 2567 - DNA, 21 bp, Zea mays
caggagtaagtaccgcctgtc

SEQ ID NO: 2568 - DNA, 21 bp, Zea mays
caacggtggcttccctaggaa

SEQ ID NO: 2569 - DNA, 21 bp, Zea mays
gggttgaccgacgaggacgtc

SEQ ID NO: 2570 - DNA, 21 bp, Zea mays
gacgacgacgacgacgcgtcg

SEQ ID NO: 2571 - DNA, 21 bp, Zea mays
ccgctaacttcctacggccgc

SEQ ID NO: 2572 - DNA, 21 bp, Zea mays
gactctcgggttgttctgggc

SEQ ID NO: 2573 - DNA, 21 bp, Zea mays
caaccaaacgcaccctaagag

SEQ ID NO: 2574 - DNA, 21 bp, Zea mays
aggcaggcaggcaggcatgtc

SEQ ID NO: 2575 - DNA, 21 bp, Zea mays
ccaagaggaggaccaggatca

SEQ ID NO: 2576 - DNA, 21 bp, Zea mays
tggactttgtgtgcggtgtgg

SEQ ID NO: 2577 - DNA, 21 bp, Zea mays
ggcctgtttggtttgtggcta

SEQ ID NO: 2578 - DNA, 21 bp, Zea mays
ttgcaacgcacgggcactcat

SEQ ID NO: 2579 - DNA, 21 bp, Zea mays
aggcccattacagaggggtga

SEQ ID NO: 2580 - DNA, 21 bp, Zea mays
gtggggccaacagggcgaatc

SEQ ID NO: 2581 - DNA, 21 bp, Zea mays
ggcactcggcaaagaaggctc

SEQ ID NO: 2582 - DNA, 21 bp, Zea mays
ctctttgccgagtgtctgctg

SEQ ID NO: 2583 - DNA, 21 bp, Zea mays
tcttgcgcagccggagctccg

SEQ ID NO: 2584 - DNA, 21 bp, Zea mays
gcttgcagcgattgagcctgg

SEQ ID NO: 2585 - DNA, 21 bp, Zea mays
gggggtgtttggtttctagga

SEQ ID NO: 2586 - DNA, 21 bp, Zea mays
ggcactcggcaaagaagtttt

SEQ ID NO: 2587 - DNA, 21 bp, Zea mays
gaggcctggacgcgaacgggg

SEQ ID NO: 2588 - DNA, 21 bp, Zea mays
aggcggttttgtcttagggtt

SEQ ID NO: 2589 - DNA, 21 bp, Zea mays
ttctttgccgagtgccagatc

SEQ ID NO: 2590 - DNA, 21 bp, Zea mays
ctggtgcgggtgcctctcagt

SEQ ID NO: 2591 - DNA, 21 bp, Zea mays
atcattggcgggtggctgagt

SEQ ID NO: 2592 - DNA, 21 bp, Zea mays
tgcctgggccggcccatcgtg

SEQ ID NO: 2593 - DNA, 21 bp, Zea mays
cactcggcaaagaacctgaca

SEQ ID NO: 2594 - DNA, 21 bp, Zea mays
agcagctgtcccaaacagggc

SEQ ID NO: 2595 - DNA, 21 bp, Zea mays
cgggcactcggcaaagatttt

SEQ ID NO: 2596 - DNA, 21 bp, Zea mays
cgagcactcggcaaagatcgt

SEQ ID NO: 2597 - DNA, 21 bp, Zea mays
gtgtccgtgcgttgcgacgga

SEQ ID NO: 2598 - DNA, 21 bp, Zea mays
cgggcactcggcaaagagctt

SEQ ID NO: 2599 - DNA, 21 bp, Zea mays
ttagccacgaaccaaacaact

SEQ ID NO: 2600 - DNA, 21 bp, Zea mays
cttcagacactcggtaaagaa

SEQ ID NO: 2601 - DNA, 21 bp, Zea mays
catagacacagacggtcccac

SEQ ID NO: 2602 - DNA, 21 bp, Zea mays
actgaccgaccatgaattctt

SEQ ID NO: 2603 - DNA, 21 bp, Zea mays
ctggctgtgactgcgcgctcc

SEQ ID NO: 2604 - DNA, 21 bp, Zea mays
ttctttgccgagtgccaaaac

SEQ ID NO: 2605 - DNA, 21 bp, Zea mays
ccctaacaggggttgggtggt

SEQ ID NO: 2606 - DNA, 21 bp, Zea mays
gaaggggagacttcgctcggc

SEQ ID NO: 2607 - DNA, 21 bp, Zea mays
tgtctttgccgagtgccgttc

SEQ ID NO: 2608 - DNA, 21 bp, Zea mays
catcgggtagcgggtatgggg

SEQ ID NO: 2609 - DNA, 21 bp, Zea mays
gcagaggagcagcggagaagc

SEQ ID NO: 2610 - DNA, 21 bp, Zea mays
acaacccctggaccgggacca

SEQ ID NO: 2611 - DNA, 21 bp, Zea mays
cgagcactcggcaaagacccg

SEQ ID NO: 2612 - DNA, 21 bp, Zea mays
gccgaaccaaacaggccctag

SEQ ID NO: 2613 - DNA, 21 bp, Zea mays
caggcggaggccaagctggcg

SEQ ID NO: 2614 - DNA, 21 bp, Zea mays
tggattgagtgagattgggtg

SEQ ID NO: 2615 - DNA, 21 bp, Zea mays
gagcaggctcgcgtgaggccg

SEQ ID NO: 2616 - DNA, 21 bp, Zea mays
aggtctttgccgagtgccaga

SEQ ID NO: 2617 - DNA, 21 bp, Zea mays
ggagatggcgctaatgacgat

SEQ ID NO: 2618 - DNA, 21 bp, Zea mays
ccagaccgggctgatccacgg

SEQ ID NO: 2619 - DNA, 21 bp, Zea mays
agagtctccccgagccacccc

SEQ ID NO: 2620 - DNA, 21 bp, Zea mays
atgaaccgagcgagccacgag

SEQ ID NO: 2621 - DNA, 21 bp, Zea mays
cttcgcgggtatgggtttggg

SEQ ID NO: 2622 - DNA, 21 bp, Zea mays
gctgtcaggagtaagtaccac

SEQ ID NO: 2623 - DNA, 21 bp, Zea mays
gccttgcctcgggcagagcca

SEQ ID NO: 2624 - DNA, 21 bp, Zea mays
gtcagcagggtggacaggcgg

SEQ ID NO: 2625 - DNA, 21 bp, Zea mays
gacgacgacgacgacgcgcgc

SEQ ID NO: 2626 - DNA, 21 bp, Zea mays
aagatctatggcgccgaggta

SEQ ID NO: 2627 - DNA, 21 bp, Zea mays
gacagcggcagcacgggggag

SEQ ID NO: 2628 - DNA, 21 bp, Zea mays
ggttctgtagcgctggactga

SEQ ID NO: 2629 - DNA, 21 bp, Zea mays
caagatctgtggcgccgagct

SEQ ID NO: 2630 - DNA, 21 bp, Zea mays
ctagctcggcgccacagatct

SEQ ID NO: 2631 - DNA, 21 bp, Zea mays
cggtgggctcggccttcttat

SEQ ID NO: 2632 - DNA, 21 bp, Zea mays
tgcccgtgcgttgcaacagaa

SEQ ID NO: 2633 - DNA, 21 bp, Zea mays
gagggatgcggagtctgggag

SEQ ID NO: 2634 - DNA, 21 bp, Zea mays
gacactcggcaaagaagtctt

SEQ ID NO: 2635 - DNA, 21 bp, Zea mays
ctggcactcggcaaagtcttt

SEQ ID NO: 2636 - DNA, 21 bp, Zea mays
ctgcgcaccttccttcgtcgg

SEQ ID NO: 2637 - DNA, 21 bp, Zea mays
aggtctttgccgagtgctgaa

SEQ ID NO: 2638 - DNA, 21 bp, Zea mays
gtgacactcgacaaagagaat

SEQ ID NO: 2639 - DNA, 21 bp, Zea mays
caaccaaacgcaccctaaaga

SEQ ID NO: 2640 - DNA, 21 bp, Zea mays
atggaccagcacgaggcacgg

SEQ ID NO: 2641 - DNA, 21 bp, Zea mays
gagcggggagcgtagggcatg

SEQ ID NO: 2642 - DNA, 21 bp, Zea mays
gtatctggctggccaggatga

SEQ ID NO: 2643 - DNA, 21 bp, Zea mays
cgtctcgaccggagtctgctg

SEQ ID NO: 2644 - DNA, 21 bp, Zea mays
ctggtctagaactgtttccga

SEQ ID NO: 2645 - DNA, 21 bp, Zea mays
ctaataggccggcccaaatca

SEQ ID NO: 2646 - DNA, 21 bp, Zea mays
tgggccgtgccagaaattgtg

SEQ ID NO: 2647 - DNA, 21 bp, Zea mays
ggcgtcgtcgtcggatgcttt

SEQ ID NO: 2648 - DNA, 21 bp, Zea mays
gaacaagctggccatcgtgaa

SEQ ID NO: 2649 - DNA, 21 bp, Zea mays
ctctttgccgagtgccacaca

SEQ ID NO: 2650 - DNA, 21 bp, Zea mays
gcgtacaggagggtcgatggc

SEQ ID NO: 2651 - DNA, 21 bp, Zea mays
aggcccattacagagggtgag

SEQ ID NO: 2652 - DNA, 21 bp, Zea mays
ggcgaagtcgtgcgtccagca

SEQ ID NO: 2653 - DNA, 21 bp, Zea mays
tggactcccaaactagcccta

SEQ ID NO: 2654 - DNA, 21 bp, Zea mays
attgcagccgcagcaagccgc

SEQ ID NO: 2655 - DNA, 21 bp, Zea mays
aatacaaacgaacaaggcctt

SEQ ID NO: 2656 - DNA, 21 bp, Zea mays
catgcttggctccttgcacgc

SEQ ID NO: 2657 - DNA, 21 bp, Zea mays
tccaccacctgtttttgacac

SEQ ID NO: 2658 - DNA, 21 bp, Zea mays
tgggtcatcgtcgtcgtcgtc

SEQ ID NO: 2659 - DNA, 21 bp, Zea mays
tatataagaaggccgagccca

SEQ ID NO: 2660 - DNA, 21 bp, Zea mays
tgacggccggccggccggccg

SEQ ID NO: 2661 - DNA, 21 bp, Zea mays
cctctggtctctttctgatct

SEQ ID NO: 2662 - DNA, 21 bp, Zea mays
gggctagccaaggagactgcc

SEQ ID NO: 2663 - DNA, 21 bp, Zea mays
ggaacggagccgctctgttct

SEQ ID NO: 2664 - DNA, 21 bp, Zea mays
aagcgatctggtgcatccgat

SEQ ID NO: 2665 - DNA, 21 bp, Zea mays
cccatcgccgcttctggcaca

SEQ ID NO: 2666 - DNA, 21 bp, Zea mays
tgggattggatgggtttgaat

SEQ ID NO: 2667 - DNA, 21 bp, Zea mays
ttcgagctaacgagctggctc

SEQ ID NO: 2668 - DNA, 21 bp, Zea mays
ctgtcagtggccgtgtcggac

SEQ ID NO: 2669 - DNA, 21 bp, Zea mays
attttgcctaaggttagtcgt

SEQ ID NO: 2670 - DNA, 21 bp, Zea mays
cctggccaatctcgtcaacct

SEQ ID NO: 2671 - DNA, 21 bp, Zea mays
gggcttgttcggttagctctc

SEQ ID NO: 2672 - DNA, 21 bp, Zea mays
gttaacttgccacactttgcc

SEQ ID NO: 2673 - DNA, 21 bp, Zea mays
cctaatcaccaaattagccct

SEQ ID NO: 2674 - DNA, 21 bp, Zea mays
agactttgttcgtttgtgccg

SEQ ID NO: 2675 - DNA, 21 bp, Zea mays
agagctgggttgcagtcggtg

SEQ ID NO: 2676 - DNA, 21 bp, Zea mays
ggccgagcccaccggcactta

SEQ ID NO: 2677 - DNA, 21 bp, Zea mays
ctgaggtcttgttcgtttgtg

SEQ ID NO: 2678 - DNA, 21 bp, Zea mays
tggcggcggcccggcgcggcg

SEQ ID NO: 2679 - DNA, 21 bp, Zea mays
agccacaaaccaaacaggccc

SEQ ID NO: 2680 - DNA, 21 bp, Zea mays
cctaagttgccacactttgcc

SEQ ID NO: 2681 - DNA, 21 bp, Zea mays
ctctcgtccgcgccgacgacg

SEQ ID NO: 2682 - DNA, 21 bp, Zea mays
gttgcttccaaacagggccta

SEQ ID NO: 2683 - DNA, 21 bp, Zea mays
gttttggctctttgccgagtg

SEQ ID NO: 2684 - DNA, 21 bp, Zea mays
tgtcgctggcactcggcaaag

SEQ ID NO: 2685 - DNA, 21 bp, Zea mays
tttggattgaagggagctctg

SEQ ID NO: 2686 - DNA, 21 bp, Zea mays
tatgttgacgtcacaagtgta

SEQ ID NO: 2687 - DNA, 21 bp, Zea mays
tggagaagcagggcacgtgca

SEQ ID NO: 2688 - DNA, 21 bp, Zea mays
attgaactacatcatgttgtt

SEQ ID NO: 2689 - DNA, 21 bp, Zea mays
tactcaatgacagggaatagg

SEQ ID NO: 2690 - DNA, 21 bp, Zea mays
gatccctggtcaccaaatcag

SEQ ID NO: 2691 - DNA, 21 bp, Zea mays
agtcccgagcatagggtccag

SEQ ID NO: 2692 - DNA, 21 bp, Zea mays
atttgattgcatgcttgcacc

SEQ ID NO: 2693 - DNA, 21 bp, Zea mays
agatgcagacgtcgggctcct

SEQ ID NO: 2694 - DNA, 21 bp, Zea mays
ggcggcggcggttgacgacga

SEQ ID NO: 2695 - DNA, 21 bp, Zea mays
ttgttcggttagctctcaatc

SEQ ID NO: 2696 - DNA, 21 bp, Zea mays
accatcaaaccaaacaggccc

SEQ ID NO: 2697 - DNA, 21 bp, Zea mays
ggcctgcgcaagaagaagccc

SEQ ID NO: 2698 - DNA, 21 bp, Zea mays
ttcgtcctgcgtccgccactg

SEQ ID NO: 2699 - DNA, 21 bp, Zea mays
ccgtcgctgagagcccgagcc

SEQ ID NO: 2700 - DNA, 21 bp, Zea mays
ccgtgccggaggaggcggtcg

SEQ ID NO: 2701 - DNA, 21 bp, Zea mays
acagcgccaacgacctcaccg

SEQ ID NO: 2702 - DNA, 21 bp, Zea mays
cttcctcccctggttctgcct

SEQ ID NO: 2703 - DNA, 21 bp, Zea mays
gggggtgggcactgccgcgtg

SEQ ID NO: 2704 - DNA, 21 bp, Zea mays
tcgctggcactcggcaaagag

SEQ ID NO: 2705 - DNA, 21 bp, Zea mays
ttaggccttgttcgtttgtgt

SEQ ID NO: 2706 - DNA, 21 bp, Zea mays
cattatgtgcaagcgtgcaag

SEQ ID NO: 2707 - DNA, 21 bp, Zea mays
attcagccacaagccatgaca

SEQ ID NO: 2708 - DNA, 21 bp, Zea mays
tatatgtccgtgcgttgcaac

SEQ ID NO: 2709 - DNA, 21 bp, Zea mays
tgtaatccgacggaaacgaac

SEQ ID NO: 2710 - DNA, 21 bp, Zea mays
tccaatccgacggaaacgaac

SEQ ID NO: 2711 - DNA, 21 bp, Zea mays
cactagaaaccaaacaccccc

SEQ ID NO: 2712 - DNA, 21 bp, Zea mays
tttttgggagcctggctgctc

SEQ ID NO: 2713 - DNA, 21 bp, Zea mays
gtctccgcttcgctcgccaac

SEQ ID NO: 2714 - DNA, 21 bp, Zea mays
ccctcgtctgcatctgctcct

SEQ ID NO: 2715 - DNA, 21 bp, Zea mays
aagggcctgtttggtttgtgg

SEQ ID NO: 2716 - DNA, 21 bp, Zea mays
gcgctacgccgccgccgagca

SEQ ID NO: 2717 - DNA, 21 bp, Zea mays
atttgatgcctaacttgccac

SEQ ID NO: 2718 - DNA, 21 bp, Zea mays
catcgccgccaaccgactgga

SEQ ID NO: 2719 - DNA, 21 bp, Zea mays
gcttgattgcatgcttgcacc

SEQ ID NO: 2720 - DNA, 21 bp, Zea mays
gcgctctccacggcagtcggc

SEQ ID NO: 2721 - DNA, 21 bp, Zea mays
catgtgcccgtgcgttgctac

SEQ ID NO: 2722 - DNA, 21 bp, Zea mays
aggttcccgtcgccgctggtg

SEQ ID NO: 2723 - DNA, 21 bp, Zea mays
tgaagctgccagcatgatctg

SEQ ID NO: 2724 - DNA, 21 bp, Zea mays
gtgtttggtttctagggacta

SEQ ID NO: 2725 - DNA, 21 bp, Zea mays
aactcacgcaactatcagcta

SEQ ID NO: 2726 - DNA, 21 bp, Zea mays
acacatcacaggcggtccagt

SEQ ID NO: 2727 - DNA, 21 bp, Zea mays
gtttctttgccgagtgtcttt

SEQ ID NO: 2728 - DNA, 21 bp, Zea mays
gagctctttgccgagtgtttt

SEQ ID NO: 2729 - DNA, 21 bp, Zea mays
gagaaaaaacactcggcaaag

SEQ ID NO: 2730 - DNA, 21 bp, Zea mays
tcgcaacgcacgggtaaccga

SEQ ID NO: 2731 - DNA, 21 bp, Zea mays
tcttagccaaaaggccgagaa

SEQ ID NO: 2732 - DNA, 21 bp, Zea mays
attcccgtcggttgtcagccg

SEQ ID NO: 2733 - DNA, 21 bp, Zea mays
acaagcaaaccatctgatcca

SEQ ID NO: 2734 - DNA, 21 bp, Zea mays
aggatggcttctacctgcaag

SEQ ID NO: 2735 - DNA, 21 bp, Zea mays
gacagcaatacagcagtcact

SEQ ID NO: 2736 - DNA, 21 bp, Zea mays
accgggttggactgtcgagtg

SEQ ID NO: 2737 - DNA, 21 bp, Zea mays
ccctagaaaccaaacaccccc

SEQ ID NO: 2738 - DNA, 21 bp, Zea mays
ggtgtttggtttctagggact

SEQ ID NO: 2739 - DNA, 21 bp, Zea mays
acagtcattttcggcggccag

SEQ ID NO: 2740 - DNA, 21 bp, Zea mays
tggaagccacaaaaccggagg

SEQ ID NO: 2741 - DNA, 21 bp, Zea mays
aaaccgctcgctgctcgtctg

SEQ ID NO: 2742 - DNA, 21 bp, Zea mays
gtcggattgcacctggaatcg

SEQ ID NO: 2743 - DNA, 21 bp, Zea mays
ggctgtttggttcgtggctaa

SEQ ID NO: 2744 - DNA, 21 bp, Zea mays
tgtggggctgcaaacagcctg

SEQ ID NO: 2745 - DNA, 21 bp, Zea mays
acgatcctccaggctccagcg

SEQ ID NO: 2746 - DNA, 21 bp, Zea mays
aggtaatggaagccctgggtt

SEQ ID NO: 2747 - DNA, 21 bp, Zea mays
gttaaacgcttgatgtgaccc

SEQ ID NO: 2748 - DNA, 21 bp, Zea mays
tcggttgtaccggaatgagcc

SEQ ID NO: 2749 - DNA, 21 bp, Zea mays
tttaggtttgtacacatagtg

SEQ ID NO: 2750 - DNA, 21 bp, Zea mays
tgattgagccgtgccaatatc

SEQ ID NO: 2751 - DNA, 21 bp, Zea mays
ggatgtgtttggttataataa

SEQ ID NO: 2752 - DNA, 21 bp, Zea mays
acttgccacactttgcctaac

SEQ ID NO: 2753 - DNA, 21 bp, Zea mays
gggtcacatcaagcgtttgac

SEQ ID NO: 2754 - DNA, 21 bp, Zea mays
tggtgcatccgatctagatct

SEQ ID NO: 2755 - DNA, 21 bp, Zea mays
cgcttggtgcagatcgggacc

SEQ ID NO: 2756 - DNA, 21 bp, Zea mays
cttaggtttgtacacatagtg

SEQ ID NO: 2757 - DNA, 21 bp, Zea mays
ggcataccttagagagaaact

SEQ ID NO: 2758 - DNA, 21 bp, Zea mays
atctcatcccgttctgtcatt

SEQ ID NO: 2759 - DNA, 21 bp, Zea mays
agacaaaatactgtagaaaaa

SEQ ID NO: 2760 - DNA, 21 bp, Zea mays
ctcaatacatcttaatccact

SEQ ID NO: 2761 - DNA, 21 bp, Zea mays
agatccgacgatatagagata

SEQ ID NO: 2762 - DNA, 21 bp, Zea mays
atgagtgaagctgccagcatg

SEQ ID NO: 2763 - DNA, 21 bp, Zea mays
tgaagctgccagcatgatcta

SEQ ID NO: 2764 - DNA, 21 bp, Zea mays
gtatgcgctgcctctaatatt

SEQ ID NO: 2765 - DNA, 21 bp, Zea mays
cgacagaagcagagctgccag

SEQ ID NO: 2766 - DNA, 21 bp, Zea mays
ctaatctaacagactcggtaa

SEQ ID NO: 2767 - DNA, 21 bp, Zea mays
tccacaggctttcttgaactg

SEQ ID NO: 2768 - DNA, 21 bp, Zea mays
tgtttgctgatggtcatctaa

SEQ ID NO: 2769 - DNA, 21 bp, Zea mays
ccgcgccacacttttaagcca

SEQ ID NO: 2770 - DNA, 21 bp, Zea mays
gaagcttaacaataacattct

SEQ ID NO: 2771 - DNA, 21 bp, Zea mays
gagctcccttcgatccaatcc

SEQ ID NO: 2772 - DNA, 21 bp, Zea mays
gttggtgaagctgccagcatg

SEQ ID NO: 2773 - DNA, 21 bp, Zea mays
ttacgttacattttgtgaacc

SEQ ID NO: 2774 - DNA, 21 bp, Zea mays
atgacggccacacaaatccac

SEQ ID NO: 2775 - DNA, 21 bp, Zea mays
atttatcacacggcttaacta

SEQ ID NO: 2776 - DNA, 21 bp, Zea mays
tccaaagggatcgcattgatc

SEQ ID NO: 2777 - DNA, 21 bp, Zea mays
cagccaaggatgacttgccgg

SEQ ID NO: 2778 - DNA, 21 bp, Zea mays
gatcagatctgcatcaactct

SEQ ID NO: 2779 - DNA, 21 bp, Zea mays
tacggttggatcatgatctaa

SEQ ID NO: 2780 - DNA, 21 bp, Zea mays
tagcctggttccatatgagag

SEQ ID NO: 2781 - DNA, 21 bp, Zea mays
agccgttgccagtcataagat

SEQ ID NO: 2782 - DNA, 21 bp, Zea mays
agaatcttgatgatgctgcat

SEQ ID NO: 2783 - DNA, 21 bp, Zea mays
ctaatccataggtcaaaaaac

SEQ ID NO: 2784 - DNA, 21 bp, Zea mays
aggttgttaaggcgttttagc

SEQ ID NO: 2785 - DNA, 21 bp, Zea mays
ttccacagctttcttgaactg

SEQ ID NO: 2786 - DNA, 21 bp, Zea mays
atactcattccttgtatgcca

SEQ ID NO: 2787 - DNA, 21 bp, Zea mays
atcacaccctccacatccaac

SEQ ID NO: 2788 - DNA, 21 bp, Zea mays
catctaaatttagaggaccgt

SEQ ID NO: 2789 - DNA, 21 bp, Zea mays
tctctaaatttagaggaccgt

SEQ ID NO: 2790 - DNA, 21 bp, Zea mays
ggtaggcgtggttttatccga

SEQ ID NO: 2791 - DNA, 21 bp, Zea mays
attttggtgcaaacgtgcaat

SEQ ID NO: 2792 - DNA, 21 bp, Zea mays
agtggccatccaagcagccct

SEQ ID NO: 2793 - DNA, 21 bp, Zea mays
aacaccctgaatttggggtat

SEQ ID NO: 2794 - DNA, 21 bp, Zea mays
cgccagcttaacgaagctacc

SEQ ID NO: 2795 - DNA, 21 bp, Zea mays
gggctgcgacctaaccatcac

SEQ ID NO: 2796 - DNA, 21 bp, Zea mays
tgtcacttggttcctgaactc

SEQ ID NO: 2797 - DNA, 21 bp, Zea mays
cgagccgggacgtggcggcag

SEQ ID NO: 2798 - DNA, 21 bp, Zea mays
ttcgtacacaacgaagcataa

SEQ ID NO: 2799 - DNA, 21 bp, Zea mays
aatgcttatgatgccatgctc

SEQ ID NO: 2800 - DNA, 21 bp, Zea mays
gaataaagacaacgaagcctg

SEQ ID NO: 2801 - DNA, 21 bp, Zea mays
tagctcggcgccataggctgt

SEQ ID NO: 2802 - DNA, 21 bp, Zea mays
atgtttggtttctagggacta

SEQ ID NO: 2803 - DNA, 21 bp, Zea mays
cccgggtcacatcaagcgttt

SEQ ID NO: 2804 - DNA, 21 bp, Zea mays
ctaaagtttagcccgggtcac

SEQ ID NO: 2805 - DNA, 21 bp, Zea mays
ccgggctaaactttagtccac

SEQ ID NO: 2806 - DNA, 21 bp, Zea mays
cgtgagctcgctcgactcgtg

SEQ ID NO: 2807 - DNA, 21 bp, Zea mays
tctgttggtccgctatctagc

SEQ ID NO: 2808 - DNA, 21 bp, Zea mays
ctgtttggttcgtggctaact

SEQ ID NO: 2809 - DNA, 21 bp, Zea mays
agtctatcctcatttttgtga

SEQ ID NO: 2810 - DNA, 21 bp, Zea mays
tgacggatatggatagccgat

SEQ ID NO: 2811 - DNA, 21 bp, Zea mays
gatctatggcgccgagctcgg

SEQ ID NO: 2812 - DNA, 21 bp, Zea mays
gctcggcgccaagatctatgg

SEQ ID NO: 2813 - DNA, 21 bp, Zea mays
ggataagcagctcgtcctcga

SEQ ID NO: 2814 - DNA, 21 bp, Zea mays
tgagctcccaaactagcccta

SEQ ID NO: 2815 - DNA, 21 bp, Zea mays
tctagctttgccgagtgcttc

SEQ ID NO: 2816 - DNA, 21 bp, Zea mays
attgcaaccaaacgcaccctt

SEQ ID NO: 2817 - DNA, 21 bp, Zea mays
cctggcgcaccgcagcagtcg

SEQ ID NO: 2818 - DNA, 21 bp, Zea mays
gcaagcaaaccatctgatcca

SEQ ID NO: 2819 - DNA, 21 bp, Zea mays
cgcatgggccaagctaagctc

SEQ ID NO: 2820 - DNA, 21 bp, Zea mays
ctgtcattgcaaccaaacgca

SEQ ID NO: 2821 - DNA, 21 bp, Zea mays
tgaatggatgagtcggcagct

SEQ ID NO: 2822 - DNA, 21 bp, Zea mays
ggcctctggcctctttctgat

SEQ ID NO: 2823 - DNA, 21 bp, Zea mays
taccgactgagctagacgggc

SEQ ID NO: 2824 - DNA, 21 bp, Zea mays
ttgtcctgcagagaaacagca

SEQ ID NO: 2825 - DNA, 21 bp, Zea mays
cggatctgggagccgccgcac

SEQ ID NO: 2826 - DNA, 21 bp, Zea mays
ccgtgcctgcttgatagtgcc

SEQ ID NO: 2827 - DNA, 21 bp, Zea mays
cgtatggctggactcgagccc

SEQ ID NO: 2828 - DNA, 21 bp, Zea mays
catgatactgatggttgcaat

SEQ ID NO: 2829 - DNA, 21 bp, Zea mays
gacaaaaaacactcggcaaag

SEQ ID NO: 2830 - DNA, 21 bp, Zea mays
agccttaggccttgttcgttt

SEQ ID NO: 2831 - DNA, 21 bp, Zea mays
ttaaggtcttgttcgtttgtg

SEQ ID NO: 2832 - DNA, 21 bp, Zea mays
tctctgattgagccgtgccaa

SEQ ID NO: 2833 - DNA, 21 bp, Zea mays
acacggaatcgttccagctaa

SEQ ID NO: 2834 - DNA, 21 bp, Zea mays
cacatcaagcgtttgactttc

SEQ ID NO: 2835 - DNA, 21 bp, Zea mays
actgtttgggaacaaagtttt

SEQ ID NO: 2836 - DNA, 21 bp, Zea mays
gacccaaacgaacaaggcctt

SEQ ID NO: 2837 - DNA, 21 bp, Zea mays
gttcgcttgctggttcgccgt

SEQ ID NO: 2838 - DNA, 21 bp, Zea mays
tttttgtcttagggtccgctt

SEQ ID NO: 2839 - DNA, 21 bp, Zea mays
ccgggtcacatcaagcgtttg

SEQ ID NO: 2840 - DNA, 21 bp, Zea mays
ggcacaaacgaacaaggcctt

SEQ ID NO: 2841 - DNA, 21 bp, Zea mays
tttctgcctaaggttagttat

SEQ ID NO: 2842 - DNA, 21 bp, Zea mays
acgtgattggttggttggccg

SEQ ID NO: 2843 - DNA, 21 bp, Zea mays
tagcaatgaggtctgtgccaa

SEQ ID NO: 2844 - DNA, 21 bp, Zea mays
tcgccgacggcggcgccctgg

SEQ ID NO: 2845 - DNA, 21 bp, Zea mays
cgaagccatccgttcagacgc

SEQ ID NO: 2846 - DNA, 21 bp, Zea mays
gcccacaaaagcacggcccac

SEQ ID NO: 2847 - DNA, 21 bp, Zea mays
cccgcaaccaaacacatccta

SEQ ID NO: 2848 - DNA, 21 bp, Zea mays
ttcttttgccgagtgctatgg

SEQ ID NO: 2849 - DNA, 21 bp, Zea mays
tttttgcctaaggttagttat

SEQ ID NO: 2850 - DNA, 21 bp, Zea mays
gggcacactcggcaaagtctc

SEQ ID NO: 2851 - DNA, 21 bp, Zea mays
gatgccttgttcgtttgtgtc

SEQ ID NO: 2852 - DNA, 21 bp, Zea mays
agcttctttgccgagtgtttt

SEQ ID NO: 2853 - DNA, 21 bp, Zea mays
gaaaacactcggcaaagaagc

SEQ ID NO: 2854 - DNA, 21 bp, Zea mays
gcttctttgccgagtgctttt

SEQ ID NO: 2855 - DNA, 21 bp, Zea mays
ggtccccattgccatctctac

SEQ ID NO: 2856 - DNA, 21 bp, Zea mays
atgtttggttcgtggctaact

SEQ ID NO: 2857 - DNA, 21 bp, Zea mays
cgtttaggccttgttcgtttc

SEQ ID NO: 2858 - DNA, 21 bp, Zea mays
cggcagaaacgaacaaggcct

SEQ ID NO: 2859 - DNA, 21 bp, Zea mays
atccggagtctcgttcacgtc

SEQ ID NO: 2860 - DNA, 21 bp, Zea mays
catgcgttgcaacggggacat

SEQ ID NO: 2861 - DNA, 21 bp, Zea mays
aatcccgggtcaccaaatcag

SEQ ID NO: 2862 - DNA, 21 bp, Zea mays
atcctggtttgctgccgggct

SEQ ID NO: 2863 - DNA, 21 bp, Zea mays
gttcactgtctaacttgccac

SEQ ID NO: 2864 - DNA, 21 bp, Zea mays
attgggggggggggggggggg

SEQ ID NO: 2865 - DNA, 21 bp, Zea mays
atgactcccaaactagcccta

SEQ ID NO: 2866 - DNA, 21 bp, Zea mays
ttgactccgtagcaacgcacg

SEQ ID NO: 2867 - DNA, 21 bp, Zea mays
tttggttgcacgcttgcacca

SEQ ID NO: 2868 - DNA, 21 bp, Zea mays
ttgtttggtttctagggacta

SEQ ID NO: 2869 - DNA, 21 bp, Zea mays
taggccttgttcgtttgtgtc

SEQ ID NO: 2870 - DNA, 21 bp, Zea mays
cgacacaaacgaacaaggcct

SEQ ID NO: 2871 - DNA, 21 bp, Zea mays
tcaacacacgttgaaagtctg

SEQ ID NO: 2872 - DNA, 21 bp, Zea mays
attcacttggtgcaaggcggg

SEQ ID NO: 2873 - DNA, 21 bp, Zea mays
gggctcgcttggtgcagatcg

SEQ ID NO: 2874 - DNA, 21 bp, Zea mays
tctaacttgccacactttgcc

SEQ ID NO: 2875 - DNA, 21 bp, Zea mays
agctcggcgccatagatcttg

SEQ ID NO: 2876 - DNA, 21 bp, Zea mays
gcacaaacgaacaaggcctca

SEQ ID NO: 2877 - DNA, 21 bp, Zea mays
gcctgacactcggcaaaggct

SEQ ID NO: 2878 - DNA, 21 bp, Zea mays
tcagcgacggtcatcagcgcc

SEQ ID NO: 2879 - DNA, 21 bp, Zea mays
attacaaccaaacgcaccctt

SEQ ID NO: 2880 - DNA, 21 bp, Zea mays
gattggtctcaaccaaagttt

SEQ ID NO: 2881 - DNA, 21 bp, Zea mays
tttgctcccaaactagcccta

SEQ ID NO: 2882 - DNA, 21 bp, Zea mays
gcatgcctaaccttaggctgt

SEQ ID NO: 2883 - DNA, 21 bp, Zea mays
ataattagccacaaaccaaac

SEQ ID NO: 2884 - DNA, 21 bp, Zea mays
acaggcagctcatccttggct

SEQ ID NO: 2885 - DNA, 21 bp, Zea mays
gactagccaaggagactgcct

SEQ ID NO: 2886 - DNA, 21 bp, Zea mays
cgcatcgtcgcaagtcacaag

SEQ ID NO: 2887 - DNA, 21 bp, Zea mays
tgcgggagatgaaaaagtagg

SEQ ID NO: 2888 - DNA, 21 bp, Zea mays
gggcttgtttggttcgtggct

SEQ ID NO: 2889 - DNA, 21 bp, Zea mays
ttctctggtcaccaaatcagc

SEQ ID NO: 2890 - DNA, 21 bp, Zea mays
gcatcagctgaaaggagcttc

SEQ ID NO: 2891 - DNA, 21 bp, Zea mays
caggcaaccaaacacatccta

SEQ ID NO: 2892 - DNA, 21 bp, Zea mays
acctgcaggtagggtcaatcc

SEQ ID NO: 2893 - DNA, 21 bp, Zea mays
ctggagccgtaccctcatcac

SEQ ID NO: 2894 - DNA, 21 bp, Zea mays
taccgttgcggccttacttgt

SEQ ID NO: 2895 - DNA, 21 bp, Zea mays
tcctctccggtatttggactc

SEQ ID NO: 2896 - DNA, 21 bp, Zea mays
atgacgcacggtcactcacct

SEQ ID NO: 2897 - DNA, 21 bp, Zea mays
ttagacctgtgctttggcgtg

SEQ ID NO: 2898 - DNA, 21 bp, Zea mays
gatcccgggtcaccaaatcag

SEQ ID NO: 2899 - DNA, 21 bp, Zea mays
aatgagattgaggttagacga

SEQ ID NO: 2900 - DNA, 21 bp, Zea mays
cctaacttgccacactttgcc

SEQ ID NO: 2901 - DNA, 21 bp, Zea mays
acggacaaccgactagtctgg

SEQ ID NO: 2902 - DNA, 21 bp, Zea mays
gagcgactccgtcgtcttctc

SEQ ID NO: 2903 - DNA, 21 bp, Zea mays
ctcggctcgtttagctcgcga

SEQ ID NO: 2904 - DNA, 21 bp, Zea mays
cctagaccgcgtctgtggcac

SEQ ID NO: 2905 - DNA, 21 bp, Zea mays
ctcatcctctaaatttagagt

SEQ ID NO: 2906 - DNA, 21 bp, Zea mays
caagatctcggaccaggcttc

SEQ ID NO: 2907 - DNA, 21 bp, Zea mays
ctaactcccaaactagcccta

SEQ ID NO: 2908 - DNA, 21 bp, Zea mays
cgtggatagccctagcatctc

SEQ ID NO: 2909 - DNA, 21 bp, Zea mays
cccgtatccgtatccgaaatt

SEQ ID NO: 2910 - DNA, 21 bp, Zea mays
tgcgatctcagccgtccattc

SEQ ID NO: 2911 - DNA, 21 bp, Zea mays
cggcacaaacgaacaaggcct

SEQ ID NO: 2912 - DNA, 21 bp, Zea mays
tccagttggcctctagcaagt

SEQ ID NO: 2913 - DNA, 21 bp, Zea mays
tctagcagcagtccaaacagc

SEQ ID NO: 2914 - DNA, 21 bp, Zea mays
gttccctgcctaacttgtcac

SEQ ID NO: 2915 - DNA, 21 bp, Zea mays
cgacagaaacgaacaaggcct

SEQ ID NO: 2916 - DNA, 21 bp, Zea mays
ctatcattgcaaccaaacgca

SEQ ID NO: 2917 - DNA, 21 bp, Zea mays
tcaatgggacccgatagccgt

SEQ ID NO: 2918 - DNA, 21 bp, Zea mays
gtcacatcaagcgtttgactt

SEQ ID NO: 2919 - DNA, 21 bp, Zea mays
tctaaaagaaaaaaaaacagc

SEQ ID NO: 2920 - DNA, 21 bp, Zea mays
gacactcggcaaagaacgcga

SEQ ID NO: 2921 - DNA, 21 bp, Zea mays
tggcaaactgtggcaactgag

SEQ ID NO: 2922 - DNA, 21 bp, Zea mays
gtggctgacagaagagagtga

SEQ ID NO: 2923 - DNA, 21 bp, Zea mays
ccaccgtcggacataagctta

SEQ ID NO: 2924 - DNA, 21 bp, Zea mays
aagcagtcggacataagctta

SEQ ID NO: 2925 - DNA, 21 bp, Zea mays
atccctggtcaccaaatcagc

SEQ ID NO: 2926 - DNA, 21 bp, Zea mays
taactcggcgtcatagcctat

SEQ ID NO: 2927 - DNA, 21 bp, Zea mays
accaaacaggccctttgtctt

SEQ ID NO: 2928 - DNA, 21 bp, Zea mays
aagatggcttctacctgcaag

SEQ ID NO: 2929 - DNA, 21 bp, Zea mays
ggacctcccaaactagcccta

SEQ ID NO: 2930 - DNA, 21 bp, Zea mays
ccacgccagcgaatctcgcac

SEQ ID NO: 2931 - DNA, 21 bp, Zea mays
cgtgctgcctcctctgctgag

SEQ ID NO: 2932 - DNA, 21 bp, Zea mays
gccggtgaccctgcgtgcgtg

SEQ ID NO: 2933 - DNA, 21 bp, Zea mays
aacacaaacgaacaaggcctt

SEQ ID NO: 2934 - DNA, 21 bp, Zea mays
tagattgctggagatagccta

SEQ ID NO: 2935 - DNA, 21 bp, Zea mays
gagaggctgcaaacagtctgg

SEQ ID NO: 2936 - DNA, 21 bp, Zea mays
agactgtttgcagcctctcac

SEQ ID NO: 2937 - DNA, 21 bp, Zea mays
gcaggctgtttgcagcccctc

SEQ ID NO: 2938 - DNA, 21 bp, Zea mays
tagtcgccctagtcgacgatt

SEQ ID NO: 2939 - DNA, 21 bp, Zea mays
cttgctcccaaactagcccta

SEQ ID NO: 2940 - DNA, 21 bp, Zea mays
attaggcgcctggtcggtcct

SEQ ID NO: 2941 - DNA, 21 bp, Zea mays
ccgagtgttctttgccgagtg

SEQ ID NO: 2942 - DNA, 21 bp, Zea mays
accagtttcaacggtcgtcat

SEQ ID NO: 2943 - DNA, 21 bp, Zea mays
cttaacttgccacactttgcc

SEQ ID NO: 2944 - DNA, 21 bp, Zea mays
ttgtttggttcgtggctaact

SEQ ID NO: 2945 - DNA, 21 bp, Zea mays
ggctttgttcgtttgcgtcgg

SEQ ID NO: 2946 - DNA, 21 bp, Zea mays
attcccgttgcaacgcacggg

SEQ ID NO: 2947 - DNA, 21 bp, Zea mays
ggaaacccgcagtccaacagt

SEQ ID NO: 2948 - DNA, 21 bp, Zea mays
tcccctccggtatttggactc

SEQ ID NO: 2949 - DNA, 21 bp, Zea mays
ccgtcgtcgtcgcactcacag

SEQ ID NO: 2950 - DNA, 21 bp, Zea mays
ctgtgcgttgcgacggctcac

SEQ ID NO: 2951 - DNA, 21 bp, Zea mays
ttgttgtgagccgtcgcaacg

SEQ ID NO: 2952 - DNA, 21 bp, Zea mays
aaaaacactcggcaaagaagc

SEQ ID NO: 2953 - DNA, 21 bp, Zea mays
ggctagccaaggagactgcct

SEQ ID NO: 2954 - DNA, 21 bp, Zea mays
acataaacgaacaaggcctca

SEQ ID NO: 2955 - DNA, 21 bp, Zea mays
ttgcactcggcaaagtggagt

SEQ ID NO: 2956 - DNA, 21 bp, Zea mays
cctgacactcggcaaagaagc

SEQ ID NO: 2957 - DNA, 21 bp, Zea mays
gacgcagtcacgactcgccta

SEQ ID NO: 2958 - DNA, 21 bp, Zea mays
tctgtaatgggtctggcccag

SEQ ID NO: 2959 - DNA, 21 bp, Zea mays
accgtccactacattgtttgg

SEQ ID NO: 2960 - DNA, 21 bp, Zea mays
gtgggtacccacgttcctaac

SEQ ID NO: 2961 - DNA, 21 bp, Zea mays
gtatttggtttctagggacta

SEQ ID NO: 2962 - DNA, 21 bp, Zea mays
gtaattagccacaaaccaaac

SEQ ID NO: 2963 - DNA, 21 bp, Zea mays
cgtcgcaacgcacgggcacat

SEQ ID NO: 2964 - DNA, 21 bp, Zea mays
cggtacaaacgaacaaggcct

SEQ ID NO: 2965 - DNA, 21 bp, Zea mays
tgtgctcccaaactagcccta

SEQ ID NO: 2966 - DNA, 21 bp, Zea mays
gactatgacgccgagaaaagg

SEQ ID NO: 2967 - DNA, 21 bp, Zea mays
gtgtgccttctttgccgagtg

SEQ ID NO: 2968 - DNA, 21 bp, Zea mays
atggctcccaaactagcccta

SEQ ID NO: 2969 - DNA, 21 bp, Zea mays
acgattcctaaccggattgct

SEQ ID NO: 2970 - DNA, 21 bp, Zea mays
gtctgacggcttagcagaggc

SEQ ID NO: 2971 - DNA, 21 bp, Zea mays
atagcccgtcagcctgctagt

SEQ ID NO: 2972 - DNA, 21 bp, Zea mays
caaccctatatccagtgtctc

SEQ ID NO: 2973 - DNA, 21 bp, Zea mays
gagcctttgccgagtgccttt

SEQ ID NO: 2974 - DNA, 21 bp, Zea mays
ctaaggtcttgttcgtttgtg

SEQ ID NO: 2975 - DNA, 21 bp, Zea mays
acagttagccacaaaccaaac

SEQ ID NO: 2976 - DNA, 21 bp, Zea mays
gtgtgccttctttgtcgagtg

SEQ ID NO: 2977 - DNA, 21 bp, Zea mays
ccctccggttttgtggctctc

SEQ ID NO: 2978 - DNA, 21 bp, Zea mays
ggctgagcccaccggcactta

SEQ ID NO: 2979 - DNA, 21 bp, Zea mays
cgacgcaaacgaacaaggcct

SEQ ID NO: 2980 - DNA, 21 bp, Zea mays
tgatctaaggccctatttggg

SEQ ID NO: 2981 - DNA, 21 bp, Zea mays
gacacaaacgaacaaggcctt

SEQ ID NO: 2982 - DNA, 21 bp, Zea mays
aaggccttgttcgtttgtgtc

SEQ ID NO: 2983 - DNA, 21 bp, Zea mays
gtaagaacgtgggtacccacg

SEQ ID NO: 2984 - DNA, 21 bp, Zea mays
caccttaggccttgttcggtt

SEQ ID NO: 2985 - DNA, 21 bp, Zea mays
atcgccgttgctccagcacgc

SEQ ID NO: 2986 - DNA, 21 bp, Zea mays
catatgggccggtctggcaca

SEQ ID NO: 2987 - DNA, 21 bp, Zea mays
cccaatcaccaaatcagctct

SEQ ID NO: 2988 - DNA, 21 bp, Zea mays
cgtcttcacctgattcttggg

SEQ ID NO: 2989 - DNA, 21 bp, Zea mays
cgggttgtttggttcgtggct

SEQ ID NO: 2990 - DNA, 21 bp, Zea mays
gggctgcaaacggcctggttt

SEQ ID NO: 2991 - DNA, 21 bp, Zea mays
gtgtcacactttgcctaaggt

SEQ ID NO: 2992 - DNA, 21 bp, Zea mays
gtccccgttgcaacgcacggg

SEQ ID NO: 2993 - DNA, 21 bp, Zea mays
tcacagatggaccgtgagaaa

SEQ ID NO: 2994 - DNA, 21 bp, Zea mays
ctatttggttcgtggctaact

SEQ ID NO: 2995 - DNA, 21 bp, Zea mays
atagttagccacaaaccaaac

SEQ ID NO: 2996 - DNA, 21 bp, Zea mays
cgccgttgacagtgtcgtcga

SEQ ID NO: 2997 - DNA, 21 bp, Zea mays
tctcgcaaccgaacaagccct

SEQ ID NO: 2998 - DNA, 21 bp, Zea mays
aagaccttgttcgtttgtgtc

SEQ ID NO: 2999 - DNA, 21 bp, Zea mays
agcacaaacgaacaaggcctt

SEQ ID NO: 3000 - DNA, 21 bp, Zea mays
ttccgttgcaacgcacgagca

SEQ ID NO: 3001 - DNA, 21 bp, Zea mays
gggtttggtttctagggacta

SEQ ID NO: 3002 - DNA, 21 bp, Zea mays
tctgatcaccaaatcagctct

SEQ ID NO: 3003 - DNA, 21 bp, Zea mays
gaggctcccaaactagcccta

SEQ ID NO: 3004 - DNA, 21 bp, Zea mays
tgtcatcctgtatcctaccct

SEQ ID NO: 3005 - DNA, 21 bp, Zea mays
aagctctttgccgagtgtttt

SEQ ID NO: 3006 - DNA, 21 bp, Zea mays
aaacgatctggtgcatccgat

SEQ ID NO: 3007 - DNA, 21 bp, Zea mays
caaagccgaccgatatggttg

SEQ ID NO: 3008 - DNA, 21 bp, Zea mays
tagggctcgctggttgtcgtc

SEQ ID NO: 3009 - DNA, 21 bp, Zea mays
gtgcttggtttctagggacta

SEQ ID NO: 3010 - DNA, 21 bp, Zea mays
agcaggtcggtcggtcggtcg

SEQ ID NO: 3011 - DNA, 21 bp, Zea mays
cggcggtcaaaccggtcggtt

SEQ ID NO: 3012 - DNA, 21 bp, Zea mays
ctggctcccatggtcaagttg

SEQ ID NO: 3013 - DNA, 21 bp, Zea mays
gattgcagccgcagcaagccg

SEQ ID NO: 3014 - DNA, 21 bp, Zea mays
agaacggagccgctctgttct

SEQ ID NO: 3015 - DNA, 21 bp, Zea mays
aggctttgttcgtttgtgccg

SEQ ID NO: 3016 - DNA, 21 bp, Zea mays
gtagccaagaacaacttgccg

SEQ ID NO: 3017 - DNA, 21 bp, Zea mays
agtccggcttcgacgaattgg

SEQ ID NO: 3018 - DNA, 21 bp, Zea mays
aaatatagatgaccaaacggt

SEQ ID NO: 3019 - DNA, 21 bp, Zea mays
agttgagagctaaccgaacaa

SEQ ID NO: 3020 - DNA, 21 bp, Zea mays
atatgggccttttcgggcttg

SEQ ID NO: 3021 - DNA, 21 bp, Zea mays
aaccaactgagctaataggcc

SEQ ID NO: 3022 - DNA, 21 bp, Zea mays
tgctaaagtttagtccgggtc

SEQ ID NO: 3023 - DNA, 21 bp, Zea mays
cacaacactcggcaaagaagc

SEQ ID NO: 3024 - DNA, 21 bp, Zea mays
ccgcacactgccaaagcaact

SEQ ID NO: 3025 - DNA, 21 bp, Zea mays
ttagacactcggcaaagaagc

SEQ ID NO: 3026 - DNA, 21 bp, Zea mays
gccttggcactcggcaaagaa

SEQ ID NO: 3027 - DNA, 21 bp, Zea mays
agacaatttgtcgagcgcttg

SEQ ID NO: 3028 - DNA, 21 bp, Zea mays
acgtttggttcgtggctaact

SEQ ID NO: 3029 - DNA, 21 bp, Zea mays
gcgctttgtcgagtgcttttt

SEQ ID NO: 3030 - DNA, 21 bp, Zea mays
tagcaatttagagactaagat

SEQ ID NO: 3031 - DNA, 21 bp, Zea mays
atcctacggcttgctcgcacg

SEQ ID NO: 3032 - DNA, 21 bp, Zea mays
ataaactttgccgagtgtctg

SEQ ID NO: 3033 - DNA, 21 bp, Zea mays
cactaccggaatccggctctt

SEQ ID NO: 3034 - DNA, 21 bp, Zea mays
cctcagccaggcccgtgggat

SEQ ID NO: 3035 - DNA, 21 bp, Zea mays
tccgcaagaccttaatcatgt

SEQ ID NO: 3036 - DNA, 21 bp, Zea mays
ttttgctcagctgtgcccttc

SEQ ID NO: 3037 - DNA, 21 bp, Zea mays
ccgtcggtttagcccttattc

SEQ ID NO: 3038 - DNA, 21 bp, Zea mays
acgggaataagggctaaaccg

SEQ ID NO: 3039 - DNA, 21 bp, Zea mays
gaatcaaacgtgcttagcgca

SEQ ID NO: 3040 - DNA, 21 bp, Zea mays
gcagatcaggtctgattccca

SEQ ID NO: 3041 - DNA, 21 bp, Zea mays
tttgttcctgtcaccaaagtt

SEQ ID NO: 3042 - DNA, 21 bp, Zea mays
cacgtcggagacctaggcggc

SEQ ID NO: 3043 - DNA, 21 bp, Zea mays
cgccgaggcggcgccgcggcg

SEQ ID NO: 3044 - DNA, 21 bp, Zea mays
ttaagaacgtgggtacccacg

SEQ ID NO: 3045 - DNA, 21 bp, Zea mays
agcgcgctcagcagaggtcga

SEQ ID NO: 3046 - DNA, 21 bp, Zea mays
ggaacagagcggcttcatcct

SEQ ID NO: 3047 - DNA, 21 bp, Zea mays
ggacaactggggacaacactg

SEQ ID NO: 3048 - DNA, 21 bp, Zea mays
cttccatgcgcaaaatgcatc

SEQ ID NO: 3049 - DNA, 21 bp, Zea mays
gctccatgcgcaaaatgcatc

SEQ ID NO: 3050 - DNA, 21 bp, Zea mays
aggcattgttggagatgctct

SEQ ID NO: 3051 - DNA, 21 bp, Zea mays
  unsure (1): n = A, C, G or T
ntgtttggtttctagggacta

SEQ ID NO: 3052 - DNA, 21 bp, Zea mays
tagcccttgttcgtttgtgtc

SEQ ID NO: 3053 - DNA, 21 bp, Zea mays
cttgccagacgagtcgtacac

SEQ ID NO: 3054 - DNA, 21 bp, Zea mays
tttctgattgagccgtgccaa

SEQ ID NO: 3055 - DNA, 21 bp, Zea mays
ctgtttggtttctagggacta

SEQ ID NO: 3056 - DNA, 21 bp, Zea mays
agtgaagctgcaacatgatct

SEQ ID NO: 3057 - DNA, 21 bp, Zea mays
gactaaagtttagtccgggtc

SEQ ID NO: 3058 - DNA, 21 bp, Zea mays
gggcacgacactaaaaagcac

SEQ ID NO: 3059 - DNA, 21 bp, Zea mays
gaggtgctactcggaagtcct

SEQ ID NO: 3060 - DNA, 21 bp, Zea mays
agcttaggccttgttcgtttc

SEQ ID NO: 3061 - DNA, 21 bp, Zea mays
cgatagaaacgaacaaggcct

SEQ ID NO: 3062 - DNA, 21 bp, Zea mays
  unsure (1)..(2)..(3): n = A, C, G or T
nnntgcaaccgaacaagccct

SEQ ID NO: 3063 - DNA, 21 bp, Zea mays
ggtgcttgttggacacagtct

SEQ ID NO: 3064 - DNA, 21 bp, Zea mays
ggacacgcagtcacaactcac

SEQ ID NO: 3065 - DNA, 21 bp, Zea mays
ccgcgtgttttggtccgatcc

SEQ ID NO: 3066 - DNA, 21 bp, Zea mays
taaagaacgtgggtacccacg

SEQ ID NO: 3067 - DNA, 21 bp, Zea mays
atggctggccaagtcaccctc

SEQ ID NO: 3068 - DNA, 21 bp, Zea mays
tttcttcaattctcttgccac

SEQ ID NO: 3069 - DNA, 21 bp, Zea mays
ttggtgccctcagttttgatg

SEQ ID NO: 3070 - DNA, 21 bp, Zea mays
tccatttggcacgaagcacga

SEQ ID NO: 3071 - DNA, 21 bp, Zea mays
acgagcattttgtccagccct

SEQ ID NO: 3072 - DNA, 21 bp, Zea mays
ctcggcgccatagcctatggc

SEQ ID NO: 3073 - DNA, 21 bp, Zea mays
tgctcggcgccataggctatg

SEQ ID NO: 3074 - DNA, 21 bp, Zea mays
tgaaccgtcgcaacgcacggg

SEQ ID NO: 3075 - DNA, 21 bp, Zea mays
gtgtctcccaaactagcccta

SEQ ID NO: 3076 - DNA, 21 bp, Zea mays
aatctatggcgccgagctcgg

SEQ ID NO: 3077 - DNA, 21 bp, Zea mays
acctcggcgccataggctatg

SEQ ID NO: 3078 - DNA, 21 bp, Zea mays
ctgtctcccttcccataagca

SEQ ID NO: 3079 - DNA, 21 bp, Zea mays
ttcacaagcggaccctaagac

SEQ ID NO: 3080 - DNA, 21 bp, Zea mays
tatgtgggccggtctggcaca

SEQ ID NO: 3081 - DNA, 21 bp, Zea mays
cagtttcaacggtcgtcgtgc

SEQ ID NO: 3082 - DNA, 21 bp, Zea mays
ctctttaggccttgttcgttt

SEQ ID NO: 3083 - DNA, 21 bp, Zea mays
ttctgcctaaggttagttctt

SEQ ID NO: 3084 - DNA, 21 bp, Zea mays
cacacgtgcaagtccaatgcg

SEQ ID NO: 3085 - DNA, 21 bp, Zea mays
atactcggcgccataggctgt

SEQ ID NO: 3086 - DNA, 21 bp, Zea mays
aattggggggggggggggggg

SEQ ID NO: 3087 - DNA, 21 bp, Zea mays
gttcccgttgcaacgcacggg

SEQ ID NO: 3088 - DNA, 21 bp, Zea mays
gcgcccgctccactccacttc

SEQ ID NO: 3089 - DNA, 21 bp, Zea mays
gccaccattccggttctgcca

SEQ ID NO: 3090 - DNA, 21 bp, Zea mays
gtgattggtttctagggacta

SEQ ID NO: 3091 - DNA, 21 bp, Zea mays
acgaatcgcgggctgggccgt

SEQ ID NO: 3092 - DNA, 21 bp, Zea mays
cttaggccctgtttggcacag

SEQ ID NO: 3093 - DNA, 21 bp, Zea mays
ctcgacaaaggctctgtcacc

SEQ ID NO: 3094 - DNA, 21 bp, Zea mays
tttaggtcttgttcgtttgtg

SEQ ID NO: 3095 - DNA, 21 bp, Zea mays
ccgcgaagtcagtcttgctgc

SEQ ID NO: 3096 - DNA, 21 bp, Zea mays
gtagctcccaaactagcccta

SEQ ID NO: 3097 - DNA, 21 bp, Zea mays
atctggtgagcctggctcagg

SEQ ID NO: 3098 - DNA, 21 bp, Zea mays
cgccgagccaatacttagtcc

SEQ ID NO: 3099 - DNA, 21 bp, Zea mays
attgaactcgggacctctcgc

SEQ ID NO: 3100 - DNA, 21 bp, Zea mays
taattgattgagccgtgccaa

SEQ ID NO: 3101 - DNA, 21 bp, Zea mays
aatcgcaggcgctagctcatc

SEQ ID NO: 3102 - DNA, 21 bp, Zea mays
acatttagccacaaaccaaac

SEQ ID NO: 3103 - DNA, 21 bp, Zea mays
agctacaaaccaaacaggccc

SEQ ID NO: 3104 - DNA, 21 bp, Zea mays
ggataactggggacaacactg

SEQ ID NO: 3105 - DNA, 21 bp, Zea mays
tcctaatccaccttaacacat

SEQ ID NO: 3106 - DNA, 21 bp, Zea mays
actaaggccctgttcggtttc

SEQ ID NO: 3107 - DNA, 21 bp, Zea mays
tcaagtgttctttgccgagtg

SEQ ID NO: 3108 - DNA, 21 bp, Zea mays
actatggattctcaggcgcca

SEQ ID NO: 3109 - DNA, 21 bp, Zea mays
cccgcaaccaaacgcaccctt

SEQ ID NO: 3110 - DNA, 21 bp, Zea mays
tcgctcatccgagcctgctct

SEQ ID NO: 3111 - DNA, 21 bp, Zea mays
tccccccagatctagcgtgtc

SEQ ID NO: 3112 - DNA, 21 bp, Zea mays
atgtccctgtgaatcacgtgc

SEQ ID NO: 3113 - DNA, 21 bp, Zea mays
aaagggacggccttttcgatc

SEQ ID NO: 3114 - DNA, 21 bp, Zea mays
ccgttctgtcccagttttgtt

SEQ ID NO: 3115 - DNA, 21 bp, Zea mays
acccggaatcgttccagctaa

SEQ ID NO: 3116 - DNA, 21 bp, Zea mays
gttatggcactcggcaaagaa

SEQ ID NO: 3117 - DNA, 21 bp, Zea mays
ccgacgcgaacccgccgcccg

SEQ ID NO: 3118 - DNA, 21 bp, Zea mays
ttggttctttgccgagtgcca

SEQ ID NO: 3119 - DNA, 21 bp, Zea mays
tactccctccatttcttttta

SEQ ID NO: 3120 - DNA, 21 bp, Zea mays
ctcggcgtcataggctatggc

SEQ ID NO: 3121 - DNA, 21 bp, Zea mays
gtatagatggccaaacgggcc

SEQ ID NO: 3122 - DNA, 21 bp, Zea mays
atatagagcgcgacgcaaacg

SEQ ID NO: 3123 - DNA, 21 bp, Zea mays
ctttaggccctgttcggtttc

SEQ ID NO: 3124 - DNA, 21 bp, Zea mays
accaggaatcgttccagctaa

SEQ ID NO: 3125 - DNA, 21 bp, Zea mays
gtttccgttgcaacgcacggg

SEQ ID NO: 3126 - DNA, 21 bp, Zea mays
tttttttgtcgagtgcttttt

SEQ ID NO: 3127 - DNA, 21 bp, Zea mays
agacacaaaccaaacaggccc

SEQ ID NO: 3128 - DNA, 21 bp, Zea mays
gacccacagcatagtgtttag

SEQ ID NO: 3129 - DNA, 21 bp, Zea mays
atttgatgatggcgcacagtg

SEQ ID NO: 3130 - DNA, 21 bp, Zea mays
ttagcaggtagcaagaacggg

SEQ ID NO: 3131 - DNA, 21 bp, Zea mays
cgtggcaacgcacgggcacat

SEQ ID NO: 3132 - DNA, 21 bp, Zea mays
tcgagtagcacctccaagtcc

SEQ ID NO: 3133 - DNA, 21 bp, Zea mays
cagcctaccccttacagcctt

SEQ ID NO: 3134 - DNA, 21 bp, Zea mays
tgcacgctccaccactctgtg

SEQ ID NO: 3135 - DNA, 21 bp, Zea mays
gccacgtaagtcgctactgac

SEQ ID NO: 3136 - DNA, 21 bp, Zea mays
cctaaggccctgttcggtttc

SEQ ID NO: 3137 - DNA, 21 bp, Zea mays
gtagccaaggacaacttgccg

SEQ ID NO: 3138 - DNA, 21 bp, Zea mays
cggtcaccaatggacgcacaa

SEQ ID NO: 3139 - DNA, 21 bp, Zea mays
ttgctcggcgccataggctgt

SEQ ID NO: 3140 - DNA, 21 bp, Zea mays
ggtgctcctcgtcgctggtga

SEQ ID NO: 3141 - DNA, 21 bp, Zea mays
catattagccacaaaccaaac

SEQ ID NO: 3142 - DNA, 21 bp, Zea mays
taaacttagacaaagtgtggc

SEQ ID NO: 3143 - DNA, 21 bp, Zea mays
gacccacagcacagtgtttag

SEQ ID NO: 3144 - DNA, 21 bp, Zea mays
ggcggcacatcacctgccagt

SEQ ID NO: 3145 - DNA, 21 bp, Zea mays
gttttgtcttagggtccgctt

SEQ ID NO: 3146 - DNA, 21 bp, Zea mays
caccagcctcggcaatgcaga

SEQ ID NO: 3147 - DNA, 21 bp, Zea mays
acgcctctactgctgacggga

SEQ ID NO: 3148 - DNA, 21 bp, Zea mays
gtcagcaaaccatctgatcca

SEQ ID NO: 3149 - DNA, 21 bp, Zea mays
cgtgcaccgtagagaaatgtg

SEQ ID NO: 3150 - DNA, 21 bp, Zea mays
ccttccggttttgtggctctc

SEQ ID NO: 3151 - DNA, 21 bp, Zea mays
ccatgctctgtctcatccctg

SEQ ID NO: 3152 - DNA, 21 bp, Zea mays
taacttatgtccgacggctgt

SEQ ID NO: 3153 - DNA, 21 bp, Zea mays
tgtttggttgcctgcacaagg

SEQ ID NO: 3154 - DNA, 21 bp, Zea mays
tgtttcccgcggcatcatgtt

SEQ ID NO: 3155 - DNA, 21 bp, Zea mays
gccgggccggcccggcccaag

SEQ ID NO: 3156 - DNA, 21 bp, Zea mays
taacacaaacgaacaaggcct

SEQ ID NO: 3157 - DNA, 21 bp, Zea mays
agattctttgccgagtgtttt

SEQ ID NO: 3158 - DNA, 21 bp, Zea mays
tgacgccgccggcgccgccgt

SEQ ID NO: 3159 - DNA, 21 bp, Zea mays
gccttccaccctctagccaac

SEQ ID NO: 3160 - DNA, 21 bp, Zea mays
atgtcattgcaaccaaacgca

SEQ ID NO: 3161 - DNA, 21 bp, Zea mays
tctggcacagctcctgcagcc

SEQ ID NO: 3162 - DNA, 21 bp, Zea mays
gcacattgttggagatgctct

SEQ ID NO: 3163 - DNA, 21 bp, Zea mays
tcgtttggtttctagggacta

SEQ ID NO: 3164 - DNA, 21 bp, Zea mays
atatactttgccgagtgtctg

SEQ ID NO: 3165 - DNA, 21 bp, Zea mays
acaccgaaccaaacacatcat

SEQ ID NO: 3166 - DNA, 21 bp, Zea mays
ggttccgtcgcaacgcacggg

SEQ ID NO: 3167 - DNA, 21 bp, Zea mays
ttgcaacgcacggacactcac

SEQ ID NO: 3168 - DNA, 21 bp, Zea mays
atctcggcgccataggctatg

SEQ ID NO: 3169 - DNA, 21 bp, Zea mays
  unsure (1)..(2): n = A, C, G or T
nncggcgccatagcctatggc

SEQ ID NO: 3170 - DNA, 21 bp, Zea mays
  unsure (1): n = A, C, G or T
nacctcaggcgacccccgcgg

SEQ ID NO: 3171 - DNA, 21 bp, Zea mays
ccgtttaactggtcacgttct

SEQ ID NO: 3172 - DNA, 21 bp, Zea mays
cccgactcatcctactttgac

SEQ ID NO: 3173 - DNA, 21 bp, Zea mays
aattgagtgcagcgctggtga

SEQ ID NO: 3174 - DNA, 21 bp, Zea mays
acgattaggcactatagtgta

SEQ ID NO: 3175 - DNA, 21 bp, Zea mays
ccatacccgcgagacaaaact

SEQ ID NO: 3176 - DNA, 21 bp, Zea mays
ttcccacccggtcaaagcacg

SEQ ID NO: 3177 - DNA, 21 bp, Zea mays
aatttggctctttgccgagtg

SEQ ID NO: 3178 - DNA, 21 bp, Zea mays
gattaccaacgcaacctgatc

SEQ ID NO: 3179 - DNA, 21 bp, Zea mays
tcatctcaatccatgtggatt

SEQ ID NO: 3180 - DNA, 21 bp, Zea mays
cttttgcaggcttgcagctct

SEQ ID NO: 3181 - DNA, 21 bp, Zea mays
aaattctttgccgagtgtttt

SEQ ID NO: 3182 - DNA, 21 bp, Zea mays
gagcgaagtcctacaggcctt

SEQ ID NO: 3183 - DNA, 21 bp, Zea mays
attgcaaccaaacacatccta

SEQ ID NO: 3184 - DNA, 21 bp, Zea mays
taaagcgccacaatctgccta

SEQ ID NO: 3185 - DNA, 21 bp, Zea mays
cgtcgtcgatctgcgcagttc

SEQ ID NO: 3186 - DNA, 21 bp, Zea mays
tgtagcctctaggaagttagc

SEQ ID NO: 3187 - DNA, 21 bp, Zea mays
taccgtgcgcgccaggtcacc

SEQ ID NO: 3188 - DNA, 21 bp, Zea mays
tgaactcccaaactagcccta

SEQ ID NO: 3189 - DNA, 21 bp, Zea mays
agattgtgccgtgctagcacc

SEQ ID NO: 3190 - DNA, 21 bp, Zea mays
agccgacaaactgtttgccac

SEQ ID NO: 3191 - DNA, 21 bp, Zea mays
taaggcgccacaatctgccta

SEQ ID NO: 3192 - DNA, 21 bp, Zea mays
ctagcctgtctcgtgcgatac

SEQ ID NO: 3193 - DNA, 21 bp, Zea mays
aaaaaaaaacactcggcaaag

SEQ ID NO: 3194 - DNA, 21 bp, Zea mays
gccgagcaaagggtccaaaac

SEQ ID NO: 3195 - DNA, 21 bp, Zea mays
tgtaagctcgctcgactcgtg

SEQ ID NO: 3196 - DNA, 21 bp, Zea mays
tttacgtcggattgcacccgg

SEQ ID NO: 3197 - DNA, 21 bp, Zea mays
ccctttgctcggcgccatagg

SEQ ID NO: 3198 - DNA, 21 bp, Zea mays
cgaaccgcctgtgatgtaaaa

SEQ ID NO: 3199 - DNA, 21 bp, Zea mays
gtgtaccgtcgcaacgcacgg

SEQ ID NO: 3200 - DNA, 21 bp, Zea mays
tgcgacactcggcaaaggctt

SEQ ID NO: 3201 - DNA, 21 bp, Zea mays
agacaagcagctcgtcctcga

SEQ ID NO: 3202 - DNA, 21 bp, Zea mays
taaacttaggcaaagtgtggc

SEQ ID NO: 3203 - DNA, 21 bp, Zea mays
ttaggaacgtgggtacccacg

SEQ ID NO: 3204 - DNA, 21 bp, Zea mays
tagaccttgttcgtttgtgtc

SEQ ID NO: 3205 - DNA, 21 bp, Zea mays
ctcgtacacgcacccgctacc

SEQ ID NO: 3206 - DNA, 21 bp, Zea mays
ggtagctcgtttagctcgcga

SEQ ID NO: 3207 - DNA, 21 bp, Zea mays
ctaaatttgcacgcccacagc

SEQ ID NO: 3208 - DNA, 21 bp, Zea mays
taagccttgttcgtttgtgtc

SEQ ID NO: 3209 - DNA, 21 bp, Zea mays
tggacacgtgtcccgccagtc

SEQ ID NO: 3210 - DNA, 21 bp, Zea mays
ttaggtgcaagagattttttc

SEQ ID NO: 3211 - DNA, 21 bp, Zea mays
taaagggggctttgccgagtg

SEQ ID NO: 3212 - DNA, 21 bp, Zea mays
cagacggtcaaacgagccgct

SEQ ID NO: 3213 - DNA, 21 bp, Zea mays
ctaacttatcacactttgcct

SEQ ID NO: 3214 - DNA, 21 bp, Zea mays
tataaggccctgttcggtttc

SEQ ID NO: 3215 - DNA, 21 bp, Zea mays
ctaagcaacgcacgggcacat

SEQ ID NO: 3216 - DNA, 21 bp, Zea mays
tgcaagcgtgcaagcagactt

SEQ ID NO: 3217 - DNA, 21 bp, Zea mays
caccggaatcgttccagctaa

SEQ ID NO: 3218 - DNA, 21 bp, Zea mays
gcccaccaaatcctggctagt

SEQ ID NO: 3219 - DNA, 21 bp, Zea mays
gtcggcgccatagatcttggc

SEQ ID NO: 3220 - DNA, 21 bp, Zea mays
ggtcggcgccaagatctatgg

SEQ ID NO: 3221 - DNA, 21 bp, Zea mays
taatggccctgtttggcacag

SEQ ID NO: 3222 - DNA, 21 bp, Zea mays
aaccttaggccttgttcgttt

SEQ ID NO: 3223 - DNA, 21 bp, Zea mays
cagtttcaatggtcgtcctgc

SEQ ID NO: 3224 - DNA, 21 bp, Zea mays
gaggggctgcaaacagtctgg

SEQ ID NO: 3225 - DNA, 21 bp, Zea mays
aagtcttcgaccgagcacttg

SEQ ID NO: 3226 - DNA, 21 bp, Zea mays
catcactgcggcctgtcagtt

SEQ ID NO: 3227 - DNA, 21 bp, Zea mays
taacgtaggtccgcccctgat

SEQ ID NO: 3228 - DNA, 21 bp, Zea mays
tcatgccggcctgctaactgt

SEQ ID NO: 3229 - DNA, 21 bp, Zea mays
gcgtttggtttctagggacta

SEQ ID NO: 3230 - DNA, 21 bp, Zea mays
tttgccgttgcaacgcacggg

SEQ ID NO: 3231 - DNA, 21 bp, Zea mays
attacaaccaaacacatccta

SEQ ID NO: 3232 - DNA, 21 bp, Zea mays
tggacgttgacgctccgttct

SEQ ID NO: 3233 - DNA, 21 bp, Zea mays
agatattgttggagatgctct

SEQ ID NO: 3234 - DNA, 21 bp, Zea mays
gacgtgacacgtgagtgggat

SEQ ID NO: 3235 - DNA, 21 bp, Zea mays
acgtgctggcacaagtacggt

SEQ ID NO: 3236 - DNA, 21 bp, Zea mays
ctaatccctcgcctacgcctc

SEQ ID NO: 3237 - DNA, 21 bp, Zea mays
attcctggtcaccaaatcagc

SEQ ID NO: 3238 - DNA, 21 bp, Zea mays
acgtagtgtaggcgtgcacac

SEQ ID NO: 3239 - DNA, 21 bp, Zea mays
gctcgcgagctggctcgttaa

SEQ ID NO: 3240 - DNA, 21 bp, Zea mays
atttccgttgcaacgcacggg

SEQ ID NO: 3241 - DNA, 21 bp, Zea mays
ttgacactcggcaaagtcttt

SEQ ID NO: 3242 - DNA, 21 bp, Zea mays
gttggctcgtttagctcgcga

SEQ ID NO: 3243 - DNA, 21 bp, Zea mays
actaacttgccacactttgcc

SEQ ID NO: 3244 - DNA, 21 bp, Zea mays
gcgaggcagtctggttggcac

SEQ ID NO: 3245 - DNA, 21 bp, Zea mays
ggagtgacttggccgtccatc

SEQ ID NO: 3246 - DNA, 21 bp, Zea mays
acggcttgttcggttagctct

SEQ ID NO: 3247 - DNA, 21 bp, Zea mays
gagctcggcgccatagatctt

SEQ ID NO: 3248 - DNA, 21 bp, Zea mays
ctcggcgccatagatcttggc

SEQ ID NO: 3249 - DNA, 21 bp, Zea mays
tggctccacatctgcacgcag

SEQ ID NO: 3250 - DNA, 21 bp, Zea mays
taaaccttgttcgtttgtgtc

SEQ ID NO: 3251 - DNA, 21 bp, Zea mays
acgtaaacgaacaaggcctca

SEQ ID NO: 3252 - DNA, 21 bp, Zea mays
gggtcctatcgggtcggatac

SEQ ID NO: 3253 - DNA, 21 bp, Zea mays
catccaatggtgctgcgtcag

SEQ ID NO: 3254 - DNA, 21 bp, Zea mays
ataccctccacatccaatggt

SEQ ID NO: 3255 - DNA, 21 bp, Zea mays
tttaggccctgtttggcacag

SEQ ID NO: 3256 - DNA, 21 bp, Zea mays
tttctacctaaggttagttat

SEQ ID NO: 3257 - DNA, 21 bp, Zea mays
gcgacccaccatcagtcacac

SEQ ID NO: 3258 - DNA, 21 bp, Zea mays
ttcaatagccgtgccgggctt

SEQ ID NO: 3259 - DNA, 21 bp, Zea mays
ggctgcctctaggaagttagc

SEQ ID NO: 3260 - DNA, 21 bp, Zea mays
acctgcgcacgccggaaacct

SEQ ID NO: 3261 - DNA, 21 bp, Zea mays
ttcccatgcgcaaaatgcatc

SEQ ID NO: 3262 - DNA, 21 bp, Zea mays
gagctcggcgtcatagcctat

SEQ ID NO: 3263 - DNA, 21 bp, Zea mays
gcagcaaccaaacaccctctt

SEQ ID NO: 3264 - DNA, 21 bp, Zea mays
ctcaccggttgtcgtcgttcg

SEQ ID NO: 3265 - DNA, 21 bp, Zea mays
cgtcccagcgcacaagaattc

SEQ ID NO: 3266 - DNA, 21 bp, Zea mays
acacaaaccaaacaggcccat

SEQ ID NO: 3267 - DNA, 21 bp, Zea mays
aacactcggcaaaggctttgc

SEQ ID NO: 3268 - DNA, 21 bp, Zea mays
aaccggaatcgttccagctaa

SEQ ID NO: 3269 - DNA, 21 bp, Zea mays
ttccctggtcaccaaatcagc

SEQ ID NO: 3270 - DNA, 21 bp, Zea mays
gccttgtttggcacagctgct

SEQ ID NO: 3271 - DNA, 21 bp, Zea mays
cgatacaaacgaacaaggcct

SEQ ID NO: 3272 - DNA, 21 bp, Zea mays
tacctcaggcgacccccgcgg

SEQ ID NO: 3273 - DNA, 21 bp, Zea mays
gccgtggccgacgacgacgat

SEQ ID NO: 3274 - DNA, 21 bp, Zea mays
ccaagtcgaccccaagcgcgg

SEQ ID NO: 3275 - DNA, 21 bp, Zea mays
ttggagagtctgttagaatga

SEQ ID NO: 3276 - DNA, 21 bp, Zea mays
tagtccttgttcgtttgtgtc

SEQ ID NO: 3277 - DNA, 21 bp, Zea mays
gtcacaaacgaacaaggcctt

SEQ ID NO: 3278 - DNA, 21 bp, Zea mays
ccgacccacacacatagtcta

SEQ ID NO: 3279 - DNA, 21 bp, Zea mays
cgtgtgccctcagttttgctg

SEQ ID NO: 3280 - DNA, 21 bp, Zea mays
tccctccgtttctttttattt

SEQ ID NO: 3281 - DNA, 21 bp, Zea mays
agtattaaatatggtctaatt

SEQ ID NO: 3282 - DNA, 21 bp, Zea mays
cctaatcctaaaccatttgga

SEQ ID NO: 3283 - DNA, 21 bp, Zea mays
tcgcgactcagcttcagcctc

SEQ ID NO: 3284 - DNA, 21 bp, Zea mays
gtgctcgctctcttctgtcaa

SEQ ID NO: 3285 - DNA, 21 bp, Zea mays
gccgcttcccggcctcctcct

SEQ ID NO: 3286 - DNA, 21 bp, Zea mays
ggacccacaaatcatagacac

SEQ ID NO: 3287 - DNA, 21 bp, Zea mays
ctgctggattggtgggtcgga

SEQ ID NO: 3288 - DNA, 21 bp, Zea mays
cccctccgtttctttttattt

SEQ ID NO: 3289 - DNA, 21 bp, Zea mays
gtcaaattataaaactaattt

SEQ ID NO: 3290 - DNA, 21 bp, Zea mays
ggactagccaaggagactgcc

SEQ ID NO: 3291 - DNA, 21 bp, Zea mays
cattctgcgatctcagccgtc

SEQ ID NO: 3292 - DNA, 21 bp, Zea mays
cgtccgccctatccccgcgac

SEQ ID NO: 3293 - DNA, 21 bp, Zea mays
ctcagcgccacagcctatggc

SEQ ID NO: 3294 - DNA, 21 bp, Zea mays
agctcggcgccataggctgtg

SEQ ID NO: 3295 - DNA, 21 bp, Zea mays
gttagccacgaaccaaacagg

SEQ ID NO: 3296 - DNA, 21 bp, Zea mays
acctgtttggttcgtggctaa

SEQ ID NO: 3297 - DNA, 21 bp, Zea mays
gagtctatcctcatttttgtg

SEQ ID NO: 3298 - DNA, 21 bp, Zea mays
tgcatcatgggtccattcctc

SEQ ID NO: 3299 - DNA, 21 bp, Zea mays
accgcatccgacgacgacgcc

SEQ ID NO: 3300 - DNA, 21 bp, Zea mays
cacagatcttggcgccgagct

SEQ ID NO: 3301 - DNA, 21 bp, Zea mays
gccgccggcatcgaggcagga

SEQ ID NO: 3302 - DNA, 21 bp, Zea mays
taccgttgcaacgcacgggca

SEQ ID NO: 3303 - DNA, 21 bp, Zea mays
aggggtggtaatggatcacga

SEQ ID NO: 3304 - DNA, 21 bp, Zea mays
ggacctatcctcatttttgtg

SEQ ID NO: 3305 - DNA, 21 bp, Zea mays
tccactctgcaacggtccaac

SEQ ID NO: 3306 - DNA, 21 bp, Zea mays
gttccgacccaccaatccggc

SEQ ID NO: 3307 - DNA, 21 bp, Zea mays
ttagccacgaaccaaacaggc

SEQ ID NO: 3308 - DNA, 21 bp, Zea mays
gtatggcagaaccgtgcacca

SEQ ID NO: 3309 - DNA, 21 bp, Zea mays
gtttggttcgtggctaactgt

SEQ ID NO: 3310 - DNA, 21 bp, Zea mays
gccacgaaccaaacagaccct

SEQ ID NO: 3311 - DNA, 21 bp, Zea mays
gaccctaagacaaaaccgcct

SEQ ID NO: 3312 - DNA, 21 bp, Zea mays
ggctcataccggtttcgtccg

SEQ ID NO: 3313 - DNA, 21 bp, Zea mays
gcatgtttggttcgtggctaa

SEQ ID NO: 3314 - DNA, 21 bp, Zea mays
atttcgagtgcaatccgacac

SEQ ID NO: 3315 - DNA, 21 bp, Zea mays
gccgtcgtcgtcggcggccac

SEQ ID NO: 3316 - DNA, 21 bp, Zea mays
cccattaagttcgacggtacc

SEQ ID NO: 3317 - DNA, 21 bp, Zea mays
tctatcctcctttttgtgagg

SEQ ID NO: 3318 - DNA, 21 bp, Zea mays
agaacttgagcagcataccca

SEQ ID NO: 3319 - DNA, 21 bp, Zea mays
gtccggcccaagcccgaaaag

SEQ ID NO: 3320 - DNA, 21 bp, Zea mays
gttgtttggtttctagggact

SEQ ID NO: 3321 - DNA, 21 bp, Zea mays
gatgtttggtttctagggact

SEQ ID NO: 3322 - DNA, 21 bp, Zea mays
agttaccaaactggcccttag

SEQ ID NO: 3323 - DNA, 21 bp, Zea mays
cgccactcatcacatgaccgg

SEQ ID NO: 3324 - DNA, 21 bp, Zea mays
taaggccttgttcgtttgtgt

SEQ ID NO: 3325 - DNA, 21 bp, Zea mays
gcctgtttggttcgtggctaa

SEQ ID NO: 3326 - DNA, 21 bp, Zea mays
gtggaggccaatctggcgcgg

SEQ ID NO: 3327 - DNA, 21 bp, Zea mays
tctctcccagtcggccagtcc

SEQ ID NO: 3328 - DNA, 21 bp, Zea mays
tcacatcaagcgtttgacttt

SEQ ID NO: 3329 - DNA, 21 bp, Zea mays
cccctgctaaagtttagcccg

SEQ ID NO: 3330 - DNA, 21 bp, Zea mays
ggcatcaaaccaaacaggccc

SEQ ID NO: 3331 - DNA, 21 bp, Zea mays
gtatgtgcccgtgcgttgcaa

SEQ ID NO: 3332 - DNA, 21 bp, Zea mays
cggtctgcttgctctcccgct

SEQ ID NO: 3333 - DNA, 21 bp, Zea mays
gcttgtttggttcgtggctaa

SEQ ID NO: 3334 - DNA, 21 bp, Zea mays
tatcctggtttgcagccggct

SEQ ID NO: 3335 - DNA, 21 bp, Zea mays
tcggcggccgtgtacgaggtg

SEQ ID NO: 3336 - DNA, 21 bp, Zea mays
ccttagaaaccaaacaccccc

SEQ ID NO: 3337 - DNA, 21 bp, Zea mays
ccacaaaaccggaggggattg

SEQ ID NO: 3338 - DNA, 21 bp, Zea mays
tcccctccggttttgtggctc

SEQ ID NO: 3339 - DNA, 21 bp, Zea mays
ctagcccctccaatcccctcc

SEQ ID NO: 3340 - DNA, 21 bp, Zea mays
ggcactgtttgggatagctcc

SEQ ID NO: 3341 - DNA, 21 bp, Zea mays
gggctgatttggtgattaggg

SEQ ID NO: 3342 - DNA, 21 bp, Zea mays
cgggtcaccaaatcagccctt

SEQ ID NO: 3343 - DNA, 21 bp, Zea mays
gtcccgtcctgtatccgtccc

SEQ ID NO: 3344 - DNA, 21 bp, Zea mays
cccccgacgcccttcatctcc

SEQ ID NO: 3345 - DNA, 21 bp, Zea mays
gtcatcaaaccaaacaggccc

SEQ ID NO: 3346 - DNA, 21 bp, Zea mays
tatagccacgaaccaaacagg

SEQ ID NO: 3347 - DNA, 21 bp, Zea mays
tccgacggcatcgtagacagc

SEQ ID NO: 3348 - DNA, 21 bp, Zea mays
cctggagtacctcgccgccga

SEQ ID NO: 3349 - DNA, 21 bp, Zea mays
acacctcggcgccaagatctg

SEQ ID NO: 3350 - DNA, 21 bp, Zea mays
tcggctcgtttagctcgcgag

SEQ ID NO: 3351 - DNA, 21 bp, Zea mays
gccatcaaaccaaacaggccc

SEQ ID NO: 3352 - DNA, 21 bp, Zea mays
cgaaccaaacagccccttagt

SEQ ID NO: 3353 - DNA, 21 bp, Zea mays
cccttccctcccgtcagcagt

SEQ ID NO: 3354 - DNA, 21 bp, Zea mays
gtcacgaaccaaacagaccct

SEQ ID NO: 3355 - DNA, 21 bp, Zea mays
gcatcgcacgggcactcacct

SEQ ID NO: 3356 - DNA, 21 bp, Zea mays
acagcgcacaggaccagcagc

SEQ ID NO: 3357 - DNA, 21 bp, Zea mays
aggcacaaaccaaacaggccc

SEQ ID NO: 3358 - DNA, 21 bp, Zea mays
gcaacgcacgggcactcacct

SEQ ID NO: 3359 - DNA, 21 bp, Zea mays
attctgcgatctcagccgtcc

SEQ ID NO: 3360 - DNA, 21 bp, Zea mays
tggggggggggggggggggtg

SEQ ID NO: 3361 - DNA, 21 bp, Zea mays
cggagcaccgagggatctttg

SEQ ID NO: 3362 - DNA, 21 bp, Zea mays
ggttatgggcctgtttggttc

SEQ ID NO: 3363 - DNA, 21 bp, Zea mays
gccacgaaccaaacaggccca

SEQ ID NO: 3364 - DNA, 21 bp, Zea mays
tgggcgggcacgctcgtggcc

SEQ ID NO: 3365 - DNA, 21 bp, Zea mays
ctagtcaccaaatcagccctt

SEQ ID NO: 3366 - DNA, 21 bp, Zea mays
ggcccatgcctgccttggggg

SEQ ID NO: 3367 - DNA, 21 bp, Zea mays
cgggtcggaatttgagactcg

SEQ ID NO: 3368 - DNA, 21 bp, Zea mays
cggttcctgccgccggaccac

SEQ ID NO: 3369 - DNA, 21 bp, Zea mays
actagggcttgtttggtttgt

SEQ ID NO: 3370 - DNA, 21 bp, Zea mays
gaaactccaatctggcccaag

SEQ ID NO: 3371 - DNA, 21 bp, Zea mays
ttcggcccggaggtcgttggt

SEQ ID NO: 3372 - DNA, 21 bp, Zea mays
ggctctgtttgggatagctcc

SEQ ID NO: 3373 - DNA, 21 bp, Zea mays
cccacgacctcaaccgctctg

SEQ ID NO: 3374 - DNA, 21 bp, Zea mays
ggtcactgacacgcgggactg

SEQ ID NO: 3375 - DNA, 21 bp, Zea mays
acttagcgtgctgtttggttc

SEQ ID NO: 3376 - DNA, 21 bp, Zea mays
tcggcaaagaacgcgattccg

SEQ ID NO: 3377 - DNA, 21 bp, Zea mays
ctggtcaccaaatcagccctt

SEQ ID NO: 3378 - DNA, 21 bp, Zea mays
ggcgactctccggcgacgaac

SEQ ID NO: 3379 - DNA, 21 bp, Zea mays
tgaaaatcggtgcgtccggtg

SEQ ID NO: 3380 - DNA, 21 bp, Zea mays
tgcaatccgacggaaacgaac

SEQ ID NO: 3381 - DNA, 21 bp, Zea mays
tcgcagcccctgcttcgtcgg

SEQ ID NO: 3382 - DNA, 21 bp, Zea mays
gtttttcctgtgtagagccct

SEQ ID NO: 3383 - DNA, 21 bp, Zea mays
accagcagcagcagcagttct

SEQ ID NO: 3384 - DNA, 21 bp, Zea mays
aaagccgtcggacataaggaa

SEQ ID NO: 3385 - DNA, 21 bp, Zea mays
tttatcctcctttttgtgagg

SEQ ID NO: 3386 - DNA, 21 bp, Zea mays
ggctgtttgcagcccctcaca

SEQ ID NO: 3387 - DNA, 21 bp, Zea mays
tgaggggctgcaaacagcctg

SEQ ID NO: 3388 - DNA, 21 bp, Zea mays
gtgcaatccgacgcaaacgaa

SEQ ID NO: 3389 - DNA, 21 bp, Zea mays
accaatccgacggaaacgaac

SEQ ID NO: 3390 - DNA, 21 bp, Zea mays
gcccagaaccgttccaagttt

SEQ ID NO: 3391 - DNA, 21 bp, Zea mays
tcatagaaaccaaacaccccc

SEQ ID NO: 3392 - DNA, 21 bp, Zea mays
agcagcacgtggcacgagcac

SEQ ID NO: 3393 - DNA, 21 bp, Zea mays
aaccgcaacattcgcaccctc

SEQ ID NO: 3394 - DNA, 21 bp, Zea mays
ggaggcccacaaacacagatc

SEQ ID NO: 3395 - DNA, 21 bp, Zea mays
ataccaggttgtcaagggcgt

SEQ ID NO: 3396 - DNA, 21 bp, Zea mays
gattgcacccggaatcgttcc

SEQ ID NO: 3397 - DNA, 21 bp, Zea mays
ggcgcataggacatcgtaacc

SEQ ID NO: 3398 - DNA, 21 bp, Zea mays
caaagcaccgagggatctttg

SEQ ID NO: 3399 - DNA, 21 bp, Zea mays
tgggagggagggagggagggg

SEQ ID NO: 3400 - DNA, 21 bp, Zea mays
gtcgccgtcaccgtcaccgtc

SEQ ID NO: 3401 - DNA, 21 bp, Zea mays
cccggtcaccaaatcagccct

SEQ ID NO: 3402 - DNA, 21 bp, Zea mays
tcccgtcgcaacgcacggaca

SEQ ID NO: 3403 - DNA, 21 bp, Zea mays
caatcagccagagcgggaccc

SEQ ID NO: 3404 - DNA, 21 bp, Zea mays
tcttatgtgcaagcgtgcaag

SEQ ID NO: 3405 - DNA, 21 bp, Zea mays
ggacaaccaggacagggatgt

SEQ ID NO: 3406 - DNA, 21 bp, Zea mays
cgaaagggcctgtttggttca

SEQ ID NO: 3407 - DNA, 21 bp, Zea mays
gtgagcactggaccagtcacc

SEQ ID NO: 3408 - DNA, 21 bp, Zea mays
agacctgtacgtggtgcgctg

SEQ ID NO: 3409 - DNA, 21 bp, Zea mays
ctggattggtgggtcggaacg

SEQ ID NO: 3410 - DNA, 21 bp, Zea mays
tagagaagcaatccagctcgg

SEQ ID NO: 3411 - DNA, 21 bp, Zea mays
gccggagccagcagccgctgc

SEQ ID NO: 3412 - DNA, 21 bp, Zea mays
agtatttggtttctagggact

SEQ ID NO: 3413 - DNA, 21 bp, Zea mays
tctttctgaaaaacaacctat

SEQ ID NO: 3414 - DNA, 21 bp, Zea mays
ctcggttcttcggttcggttc

SEQ ID NO: 3415 - DNA, 21 bp, Zea mays
tcctcggttcggttagttcgg

SEQ ID NO: 3416 - DNA, 21 bp, Zea mays
ggtacaaacgaacaaggcctg

SEQ ID NO: 3417 - DNA, 21 bp, Zea mays
ctagcacgcaagcactgctac

SEQ ID NO: 3418 - DNA, 21 bp, Zea mays
agacgccgccgtcggtcgtct

SEQ ID NO: 3419 - DNA, 21 bp, Zea mays
aacttagggtgcgtttggttg

SEQ ID NO: 3420 - DNA, 21 bp, Zea mays
gcgccgaggtaacacagctcg

SEQ ID NO: 3421 - DNA, 21 bp, Zea mays
ccaaagcacacaatttctggc

SEQ ID NO: 3422 - DNA, 21 bp, Zea mays
tctcgcccacgtgaacgatgc

SEQ ID NO: 3423 - DNA, 21 bp, Zea mays
ccgggtcaccaaatcagccct

SEQ ID NO: 3424 - DNA, 21 bp, Zea mays
tagccacaaaaccggagggga

SEQ ID NO: 3425 - DNA, 21 bp, Zea mays
gcgctttgccgagtgcttttt

SEQ ID NO: 3426 - DNA, 21 bp, Zea mays
cgtcccaaacccgtacccgtg

SEQ ID NO: 3427 - DNA, 21 bp, Zea mays
tcctccgctctcctctctcac

SEQ ID NO: 3428 - DNA, 21 bp, Zea mays
gggccgtggcaccttgtgagc

SEQ ID NO: 3429 - DNA, 21 bp, Zea mays
cgacctgtacgtggtgcgctg

SEQ ID NO: 3430 - DNA, 21 bp, Zea mays
gtgggagccagcagccgctgc

SEQ ID NO: 3431 - DNA, 21 bp, Zea mays
tgtctgcctgcctgcctgcct

SEQ ID NO: 3432 - DNA, 21 bp, Zea mays
tcccgcgccgcagttgtggtg

SEQ ID NO: 3433 - DNA, 21 bp, Zea mays
ctctagaaaccaaacaccccc

SEQ ID NO: 3434 - DNA, 21 bp, Zea mays
tcgagcagcccgcacgacgca

SEQ ID NO: 3435 - DNA, 21 bp, Zea mays
gacccaaacgaacaaggcctg

SEQ ID NO: 3436 - DNA, 21 bp, Zea mays
ccggttcgggtcacgtgccag

SEQ ID NO: 3437 - DNA, 21 bp, Zea mays
gcccgacttgccagaaaagtc

SEQ ID NO: 3438 - DNA, 21 bp, Zea mays
tataatccgacggaaacgaac

SEQ ID NO: 3439 - DNA, 21 bp, Zea mays
cgtccgcattccacggcctcg

SEQ ID NO: 3440 - DNA, 21 bp, Zea mays
gtggctcccaaactagccctc

SEQ ID NO: 3441 - DNA, 21 bp, Zea mays
tcttagaaaccaaacaccccc

SEQ ID NO: 3442 - DNA, 21 bp, Zea mays
tacatcatgggtccattcctc

SEQ ID NO: 3443 - DNA, 21 bp, Zea mays
agttagccacaaaccaaacat

SEQ ID NO: 3444 - DNA, 21 bp, Zea mays
tggcgcggatctctgcccctg

SEQ ID NO: 3445 - DNA, 21 bp, Zea mays
cccacaacttaagaagttgct

SEQ ID NO: 3446 - DNA, 21 bp, Zea mays
ctgatcaccaaatcagccctt

SEQ ID NO: 3447 - DNA, 21 bp, Zea mays
gaggttggtcaaggctgaagg

SEQ ID NO: 3448 - DNA, 21 bp, Zea mays
actaacttcctacggctgact

SEQ ID NO: 3449 - DNA, 21 bp, Zea mays
ccatagaaaccaaacaccccc

SEQ ID NO: 3450 - DNA, 21 bp, Zea mays
acgaccaagtccctgtcgagc

SEQ ID NO: 3451 - DNA, 21 bp, Zea mays
gtgagtgcccgtgcgttgcaa

SEQ ID NO: 3452 - DNA, 21 bp, Zea mays
agtgtttggtttctagggact

SEQ ID NO: 3453 - DNA, 21 bp, Zea mays
gtcagtgcccgtgcgttgcaa

SEQ ID NO: 3454 - DNA, 21 bp, Zea mays
ccgcccactctgcaatggccc

SEQ ID NO: 3455 - DNA, 21 bp, Zea mays
aaccgctgcgggagatgaaaa

SEQ ID NO: 3456 - DNA, 21 bp, Zea mays
atcctctagccaacatgactc

SEQ ID NO: 3457 - DNA, 21 bp, Zea mays
atgggagctagccgccaacac

SEQ ID NO: 3458 - DNA, 21 bp, Zea mays
agggtcaccaaatcagccctt

SEQ ID NO: 3459 - DNA, 21 bp, Zea mays
gttaggtccatcacggtcgtg

SEQ ID NO: 3460 - DNA, 21 bp, Zea mays
ggttgtttggttcgtggctaa

SEQ ID NO: 3461 - DNA, 21 bp, Zea mays
ctctgcccggaggtcgttggt

SEQ ID NO: 3462 - DNA, 21 bp, Zea mays
cgtcgtttggttcgtggctaa

SEQ ID NO: 3463 - DNA, 21 bp, Zea mays
ggggtttggtttctagggact

SEQ ID NO: 3464 - DNA, 21 bp, Zea mays
tgccatccgacggaaacgaac

SEQ ID NO: 3465 - DNA, 21 bp, Zea mays
cctaagggcctgttcggttgc

SEQ ID NO: 3466 - DNA, 21 bp, Zea mays
cacttagggcctgtttggttc

SEQ ID NO: 3467 - DNA, 21 bp, Zea mays
ggacccacacgcctgtctctg

SEQ ID NO: 3468 - DNA, 21 bp, Zea mays
aagggcccgttcggttgtacc

SEQ ID NO: 3469 - DNA, 21 bp, Zea mays
caaacccgtacccgcgaagaa

SEQ ID NO: 3470 - DNA, 21 bp, Zea mays
tgtgtttggtttctagggact

SEQ ID NO: 3471 - DNA, 21 bp, Zea mays
ttgatcaccaaatcagccctt

SEQ ID NO: 3472 - DNA, 21 bp, Zea mays
taggtgcccgtgcgatgccac

SEQ ID NO: 3473 - DNA, 21 bp, Zea mays
gcgctacgcagtgtgccgctt

SEQ ID NO: 3474 - DNA, 21 bp, Zea mays
cacgcgggcgggcgggcgggc

SEQ ID NO: 3475 - DNA, 21 bp, Zea mays
acatgtttggttcgtggctaa

SEQ ID NO: 3476 - DNA, 21 bp, Zea mays
ttatgtccgacggcttagcgg

SEQ ID NO: 3477 - DNA, 21 bp, Zea mays
aggattgggcctctggcctct

SEQ ID NO: 3478 - DNA, 21 bp, Zea mays
tattgtgtccgtgccagcact

SEQ ID NO: 3479 - DNA, 21 bp, Zea mays
gcacgtttggttcgtggctaa

SEQ ID NO: 3480 - DNA, 21 bp, Zea mays
tctgcgacacggcctcccacg

SEQ ID NO: 3481 - DNA, 21 bp, Zea mays
ttccgtggcatcgtacgagca

SEQ ID NO: 3482 - DNA, 21 bp, Zea mays
gaccctgtttgggatagctcc

SEQ ID NO: 3483 - DNA, 21 bp, Zea mays
gttttttgctcagctgtgccc

SEQ ID NO: 3484 - DNA, 21 bp, Zea mays
cgcgaggcagccgaagacccg

SEQ ID NO: 3485 - DNA, 21 bp, Zea mays
ttgggccttgttcgtttgtgt

SEQ ID NO: 3486 - DNA, 21 bp, Zea mays
ccgggacaccgccgccatcgc

SEQ ID NO: 3487 - DNA, 21 bp, Zea mays
gtttgatgcctaacttgccac

SEQ ID NO: 3488 - DNA, 21 bp, Zea mays
cactaacgggccggcgtcaac

SEQ ID NO: 3489 - DNA, 21 bp, Zea mays
tcgggcctgtttggtttgtgg

SEQ ID NO: 3490 - DNA, 21 bp, Zea mays
tgccgggcggcgggcaccgca

SEQ ID NO: 3491 - DNA, 21 bp, Zea mays
ccataagcactagctgagtct

SEQ ID NO: 3492 - DNA, 21 bp, Zea mays
tcccctacgcctccaacaagg

SEQ ID NO: 3493 - DNA, 21 bp, Zea mays
  unsure (1)..(2): n = A, C, G or T
nntgtttggtttctagggact

SEQ ID NO: 3494 - DNA, 21 bp, Zea mays
cctctcgcctccgtcgtcgtc

SEQ ID NO: 3495 - DNA, 21 bp, Zea mays
aagagagccgagccgagccga

SEQ ID NO: 3496 - DNA, 21 bp, Zea mays
gatctcggtgcctgttgttcc

SEQ ID NO: 3497 - DNA, 21 bp, Zea mays
caaacctgctggagatagcct

SEQ ID NO: 3498 - DNA, 21 bp, Zea mays
ccaagtctgttggattagcct

SEQ ID NO: 3499 - DNA, 21 bp, Zea mays
tggactcccaaactagccctc

SEQ ID NO: 3500 - DNA, 21 bp, Zea mays
agccgcctcgcctggagctcg

SEQ ID NO: 3501 - DNA, 21 bp, Zea mays
tttggcccagcctggcccatg

SEQ ID NO: 3502 - DNA, 21 bp, Zea mays
ctaacttgtcacactttgcct

SEQ ID NO: 3503 - DNA, 21 bp, Zea mays
ttatctccgacggcctcgtac

SEQ ID NO: 3504 - DNA, 21 bp, Zea mays
ctctttgccgagtgtcaaaaa

SEQ ID NO: 3505 - DNA, 21 bp, Zea mays
aacactcggcgaagaagctct

SEQ ID NO: 3506 - DNA, 21 bp, Zea mays
cagccgattaccaacgcagcc

SEQ ID NO: 3507 - DNA, 21 bp, Zea mays
ggttcgaatccatttggcacg

SEQ ID NO: 3508 - DNA, 21 bp, Zea mays
gtaacgcacgggcactcacct

SEQ ID NO: 3509 - DNA, 21 bp, Zea mays
gcgacgcacgggcactcacct

SEQ ID NO: 3510 - DNA, 21 bp, Zea mays
gagttgcagtagccgggacag

SEQ ID NO: 3511 - DNA, 21 bp, Zea mays
aacaacgagcattttgtccag

SEQ ID NO: 3512 - DNA, 21 bp, Zea mays
atgctcggcgccataggctat

SEQ ID NO: 3513 - DNA, 21 bp, Zea mays
tgtaccctcctcctggtggtg

SEQ ID NO: 3514 - DNA, 21 bp, Zea mays
tctgaccaatgggccccaggg

SEQ ID NO: 3515 - DNA, 21 bp, Zea mays
gaccctttgctcggcgctata

SEQ ID NO: 3516 - DNA, 21 bp, Zea mays
ggcgccaaaccctagcacgcg

SEQ ID NO: 3517 - DNA, 21 bp, Zea mays
gcagcgaaccaaacagaccct

SEQ ID NO: 3518 - DNA, 21 bp, Zea mays
tcgacaggcgaactcacccgt

SEQ ID NO: 3519 - DNA, 21 bp, Zea mays
ttaaccacgaaccaaacaggc

SEQ ID NO: 3520 - DNA, 21 bp, Zea mays
cgtgtttggtttctagggact

SEQ ID NO: 3521 - DNA, 21 bp, Zea mays
cacggcttgttcgctgcggct

SEQ ID NO: 3522 - DNA, 21 bp, Zea mays
gtccacgctgcaatgtcacac

SEQ ID NO: 3523 - DNA, 21 bp, Zea mays
aatcccgcagacagccactcc

SEQ ID NO: 3524 - DNA, 21 bp, Zea mays
acaatcacccgcagcagcaat

SEQ ID NO: 3525 - DNA, 21 bp, Zea mays
tagaagccacaaaaccggagg

SEQ ID NO: 3526 - DNA, 21 bp, Zea mays
tcaggccttgttcgtttgtgt

SEQ ID NO: 3527 - DNA, 21 bp, Zea mays
tggttgctcctgctaaagttt

SEQ ID NO: 3528 - DNA, 21 bp, Zea mays
atttagccacaaaccaaacat

SEQ ID NO: 3529 - DNA, 21 bp, Zea mays
catcgggcttcacgcgtgctc

SEQ ID NO: 3530 - DNA, 21 bp, Zea mays
tggtggctcgactcggctcgt

SEQ ID NO: 3531 - DNA, 21 bp, Zea mays
catgacatcctccgatccggc

SEQ ID NO: 3532 - DNA, 21 bp, Zea mays
cctagtcaccaaatcagccct

SEQ ID NO: 3533 - DNA, 21 bp, Zea mays
tggctgtctcgcaaccaaaca

SEQ ID NO: 3534 - DNA, 21 bp, Zea mays
gtcccgtcctgtcattgcaac

SEQ ID NO: 3535 - DNA, 21 bp, Zea mays
ggcccggcacgacacatagtg

SEQ ID NO: 3536 - DNA, 21 bp, Zea mays
ggccaggctcaccagatacga

SEQ ID NO: 3537 - DNA, 21 bp, Zea mays
gagcctggctctggagatgcg

SEQ ID NO: 3538 - DNA, 21 bp, Zea mays
accctctagccaacatgactc

SEQ ID NO: 3539 - DNA, 21 bp, Zea mays
tagccgccggtgtagccgccg

SEQ ID NO: 3540 - DNA, 21 bp, Zea mays
taccagccgcagccgcagccg

SEQ ID NO: 3541 - DNA, 21 bp, Zea mays
cctagggcttgtttggtttgt

SEQ ID NO: 3542 - DNA, 21 bp, Zea mays
aggcgccacagatcttggtgc

SEQ ID NO: 3543 - DNA, 21 bp, Zea mays
agggctcgtttgtttctgctg

SEQ ID NO: 3544 - DNA, 21 bp, Zea mays
acgctgcctgcctgcctgcct

SEQ ID NO: 3545 - DNA, 21 bp, Zea mays
ggcaaccgctgaagacagtct

SEQ ID NO: 3546 - DNA, 21 bp, Zea mays
aacgtatcttgtgcgcaagga

SEQ ID NO: 3547 - DNA, 21 bp, Zea mays
aattagccacaaaccaaacat

SEQ ID NO: 3548 - DNA, 21 bp, Zea mays
agcccgggtcacatcaagcgt

SEQ ID NO: 3549 - DNA, 21 bp, Zea mays
cttgccagccacacgatcttc

SEQ ID NO: 3550 - DNA, 21 bp, Zea mays
tatcccaaacccgtacccgtg

SEQ ID NO: 3551 - DNA, 21 bp, Zea mays
aggcccaacaccagtcagccc

SEQ ID NO: 3552 - DNA, 21 bp, Zea mays
cggctgccctgcgtatgtcgc

SEQ ID NO: 3553 - DNA, 21 bp, Zea mays
cacacacgcccaatgctacgc

SEQ ID NO: 3554 - DNA, 21 bp, Zea mays
ctcggcgccacagcctatggc

SEQ ID NO: 3555 - DNA, 21 bp, Zea mays
tgggcctggctcccgagatac

SEQ ID NO: 3556 - DNA, 21 bp, Zea mays
tacaatccgacggaaacgaac

SEQ ID NO: 3557 - DNA, 21 bp, Zea mays
ccctgttacgtccacggttac

SEQ ID NO: 3558 - DNA, 21 bp, Zea mays
gtcctcctctacgtcacctct

SEQ ID NO: 3559 - DNA, 21 bp, Zea mays
ccttatgtgcaagcgtgcaag

SEQ ID NO: 3560 - DNA, 21 bp, Zea mays
acctagaaaccaaacaccccc

SEQ ID NO: 3561 - DNA, 21 bp, Zea mays
atatatgggcctgtttggttc

SEQ ID NO: 3562 - DNA, 21 bp, Zea mays
attaaagccgcagcaagccgc

SEQ ID NO: 3563 - DNA, 21 bp, Zea mays
gacgtttacatggcctgctgg

SEQ ID NO: 3564 - DNA, 21 bp, Zea mays
gactgtttggttcgtggctaa

SEQ ID NO: 3565 - DNA, 21 bp, Zea mays
tagtgccttgttcgtttgtgt

SEQ ID NO: 3566 - DNA, 21 bp, Zea mays
gccaggggacaccgctgcggc

SEQ ID NO: 3567 - DNA, 21 bp, Zea mays
gtcgtttggtttctagggact

SEQ ID NO: 3568 - DNA, 21 bp, Zea mays
ctgttcggttgctcaggaacg

SEQ ID NO: 3569 - DNA, 21 bp, Zea mays
agctcgctccaaacacgatct

SEQ ID NO: 3570 - DNA, 21 bp, Zea mays
  unsure (1): n = A, C, G or T
ncggcgccatagcctatggcg

SEQ ID NO: 3571 - DNA, 21 bp, Zea mays
cccccgactcatcctactttg

SEQ ID NO: 3572 - DNA, 21 bp, Zea mays
cactagcgtgctgtttggttc

SEQ ID NO: 3573 - DNA, 21 bp, Zea mays
cccattagggcttgttcggtt

SEQ ID NO: 3574 - DNA, 21 bp, Zea mays
ggccatgttcggttacaccaa

SEQ ID NO: 3575 - DNA, 21 bp, Zea mays
gccacgagtcgagcgagctca

SEQ ID NO: 3576 - DNA, 21 bp, Zea mays
tgactgtctcgcaaccaaaca

SEQ ID NO: 3577 - DNA, 21 bp, Zea mays
ggagcaagcctatcgtgcttc

SEQ ID NO: 3578 - DNA, 21 bp, Zea mays
tcctctccggttttgtggctc

SEQ ID NO: 3579 - DNA, 21 bp, Zea mays
ccgagttcgatccccctcggg

SEQ ID NO: 3580 - DNA, 21 bp, Zea mays
tcccgttgcaacgcacgggca

SEQ ID NO: 3581 - DNA, 21 bp, Zea mays
ggtatttggtttctagggact

SEQ ID NO: 3582 - DNA, 21 bp, Zea mays
aagcactcggcaaagcctaga

SEQ ID NO: 3583 - DNA, 21 bp, Zea mays
taggaaccaagcctgcggcag

SEQ ID NO: 3584 - DNA, 21 bp, Zea mays
cgccgagcaacccagcgaggc

SEQ ID NO: 3585 - DNA, 21 bp, Zea mays
ataacgggagccctgggcttc

SEQ ID NO: 3586 - DNA, 21 bp, Zea mays
tcctggagcgctccggcggca

SEQ ID NO: 3587 - DNA, 21 bp, Zea mays
gtcacatcaagtgtttgactt

SEQ ID NO: 3588 - DNA, 21 bp, Zea mays
attgctcccaaactagccctc

SEQ ID NO: 3589 - DNA, 21 bp, Zea mays
aacgattcctgaccggattgc

SEQ ID NO: 3590 - DNA, 21 bp, Zea mays
aaccttaagttcgacggtacc

SEQ ID NO: 3591 - DNA, 21 bp, Zea mays
ctaacccctccaatcccctcc

SEQ ID NO: 3592 - DNA, 21 bp, Zea mays
cccccttcgtagcggaccgct

SEQ ID NO: 3593 - DNA, 21 bp, Zea mays
caaggcgctcaacactaccgt

SEQ ID NO: 3594 - DNA, 21 bp, Zea mays
gcagttagtccacctcgccgt

SEQ ID NO: 3595 - DNA, 21 bp, Zea mays
gggcatgttcggttacaccaa

SEQ ID NO: 3596 - DNA, 21 bp, Zea mays
ggacttgttcggttacaccaa

SEQ ID NO: 3597 - DNA, 21 bp, Zea mays
tcccctaccactccgtctatg

SEQ ID NO: 3598 - DNA, 21 bp, Zea mays
ttgaagcggcccacccgactg

SEQ ID NO: 3599 - DNA, 21 bp, Zea mays
gctaacttcctacggctgact

SEQ ID NO: 3600 - DNA, 21 bp, Zea mays
gctagccgagtcgtcgcccca

SEQ ID NO: 3601 - DNA, 21 bp, Zea mays
ttaagccttgttcgtttgtgt

SEQ ID NO: 3602 - DNA, 21 bp, Zea mays
tttgacactcggcaaagcccc

SEQ ID NO: 3603 - DNA, 21 bp, Zea mays
ccaggcacggcccgtgagcct

SEQ ID NO: 3604 - DNA, 21 bp, Zea mays
aagcctgctggactgatgaat

SEQ ID NO: 3605 - DNA, 21 bp, Zea mays
agcgaaccaaacaccaaaagt

SEQ ID NO: 3606 - DNA, 21 bp, Zea mays
atggctcccaaactagccctc

SEQ ID NO: 3607 - DNA, 21 bp, Zea mays
ttttttgccgagtgtcaaaaa

SEQ ID NO: 3608 - DNA, 21 bp, Zea mays
ggccgtttggttcgtggctaa

SEQ ID NO: 3609 - DNA, 21 bp, Zea mays
ccgcctggaaggaatcccgac

SEQ ID NO: 3610 - DNA, 21 bp, Zea mays
ggctagtttggcagcaacgtg

SEQ ID NO: 3611 - DNA, 21 bp, Zea mays
gtttagaggacgttgctggag

SEQ ID NO: 3612 - DNA, 21 bp, Zea mays
gggcccccacaaacatgcaag

SEQ ID NO: 3613 - DNA, 21 bp, Zea mays
cataacgacgatggcggcggc

SEQ ID NO: 3614 - DNA, 21 bp, Zea mays
tatgtccgacggctttggccg

SEQ ID NO: 3615 - DNA, 21 bp, Zea mays
cgtcgagcaacccagcgaggc

SEQ ID NO: 3616 - DNA, 21 bp, Zea mays
ggcttattcccgtcggttttc

SEQ ID NO: 3617 - DNA, 21 bp, Zea mays
tttggtttcctgtaccgactc

SEQ ID NO: 3618 - DNA, 21 bp, Zea mays
ctctttgccgagtgtcacact

SEQ ID NO: 3619 - DNA, 21 bp, Zea mays
cggatcaccaaatcagccctt

SEQ ID NO: 3620 - DNA, 21 bp, Zea mays
ataagctgtgccaaacagagc

SEQ ID NO: 3621 - DNA, 21 bp, Zea mays
catatccgtcacccgatggac

SEQ ID NO: 3622 - DNA, 21 bp, Zea mays
tgaggggctgcaaacagtctg

SEQ ID NO: 3623 - DNA, 21 bp, Zea mays
gactgtttgcagcccctcaca

SEQ ID NO: 3624 - DNA, 21 bp, Zea mays
cctgggccgacggtttctgca

SEQ ID NO: 3625 - DNA, 21 bp, Zea mays
gtgaagccgcgcgacgagaat

SEQ ID NO: 3626 - DNA, 21 bp, Zea mays
ttctctccggttttgtggctc

SEQ ID NO: 3627 - DNA, 21 bp, Zea mays
cgactcaggcccaagcacggc

SEQ ID NO: 3628 - DNA, 21 bp, Zea mays
caccagcctgccgctgagaga

SEQ ID NO: 3629 - DNA, 21 bp, Zea mays
cctgtcgtctcgctggacacg

SEQ ID NO: 3630 - DNA, 21 bp, Zea mays
tgctggcccaagcacggcacg

SEQ ID NO: 3631 - DNA, 21 bp, Zea mays
gcttctgctagtccttgcacg

SEQ ID NO: 3632 - DNA, 21 bp, Zea mays
agcttctttgccgagtgcccg

SEQ ID NO: 3633 - DNA, 21 bp, Zea mays
gacgccctctccgagtctcgg

SEQ ID NO: 3634 - DNA, 21 bp, Zea mays
agtgggccttctctaggcgca

SEQ ID NO: 3635 - DNA, 21 bp, Zea mays
gtgctggcccaggcacggcac

SEQ ID NO: 3636 - DNA, 21 bp, Zea mays
ctgcgtgccgtgcctgggcca

SEQ ID NO: 3637 - DNA, 21 bp, Zea mays
ctttagaaaccaaacaccccc

SEQ ID NO: 3638 - DNA, 21 bp, Zea mays
ggcgtttggtttctagggact

SEQ ID NO: 3639 - DNA, 21 bp, Zea mays
tgcaatagctgtcatgcgccc

SEQ ID NO: 3640 - DNA, 21 bp, Zea mays
tgccctgttggaaggtgtttt

SEQ ID NO: 3641 - DNA, 21 bp, Zea mays
caatcgtggctgggccgctgg

SEQ ID NO: 3642 - DNA, 21 bp, Zea mays
tggtggcgatgggcgcaccgg

SEQ ID NO: 3643 - DNA, 21 bp, Zea mays
tatgtacgcagtgcagtccct

SEQ ID NO: 3644 - DNA, 21 bp, Zea mays
atccgatccgagccgagccga

SEQ ID NO: 3645 - DNA, 21 bp, Zea mays
tgactgatttggtgattaggg

SEQ ID NO: 3646 - DNA, 21 bp, Zea mays
tcgagaacccgaatagaccga

SEQ ID NO: 3647 - DNA, 21 bp, Zea mays
cctggtcaccaaatcagccct

SEQ ID NO: 3648 - DNA, 21 bp, Zea mays
tcactgcctgcctgcctgcct

SEQ ID NO: 3649 - DNA, 21 bp, Zea mays
tttaagggagggagggaggga

SEQ ID NO: 3650 - DNA, 21 bp, Zea mays
gcgcagtagctggctgcgcgg

SEQ ID NO: 3651 - DNA, 21 bp, Zea mays
tcgcggtcgttctcacatggg

SEQ ID NO: 3652 - DNA, 21 bp, Zea mays
gttggcttgctcggtttatgg

SEQ ID NO: 3653 - DNA, 21 bp, Zea mays
tatgtttggtttctagggact

SEQ ID NO: 3654 - DNA, 21 bp, Zea mays
ttccgttgcaacgcacgggca

SEQ ID NO: 3655 - DNA, 21 bp, Zea mays
atccacatacacggcgttgct

SEQ ID NO: 3656 - DNA, 21 bp, Zea mays
gctaagagcaactccaatagt

SEQ ID NO: 3657 - DNA, 21 bp, Zea mays
atggtcaccaaatcagccctt

SEQ ID NO: 3658 - DNA, 21 bp, Zea mays
tctggtcaccaaatcagccct

SEQ ID NO: 3659 - DNA, 21 bp, Zea mays
gtctgtttggttcgtggctaa

SEQ ID NO: 3660 - DNA, 21 bp, Zea mays
tgcaggcagaaccgtgcacca

SEQ ID NO: 3661 - DNA, 21 bp, Zea mays
ttggctcgtttagctcgcgag

SEQ ID NO: 3662 - DNA, 21 bp, Zea mays
agcgggtcgtgtttgggcctc

SEQ ID NO: 3663 - DNA, 21 bp, Zea mays
cgaggcagtctggttggcacg

SEQ ID NO: 3664 - DNA, 21 bp, Zea mays
gcgggagccagcagccgctgc

SEQ ID NO: 3665 - DNA, 21 bp, Zea mays
gtctcggccgagaaaatcccc

SEQ ID NO: 3666 - DNA, 21 bp, Zea mays
tcctttcgcaggggtcttcag

SEQ ID NO: 3667 - DNA, 21 bp, Zea mays
ctaaacccgcacctgaacccg

SEQ ID NO: 3668 - DNA, 21 bp, Zea mays
gtgacaagtgcgcctgcgtgc

SEQ ID NO: 3669 - DNA, 21 bp, Zea mays
tacttagggtgcgtttggttg

SEQ ID NO: 3670 - DNA, 21 bp, Zea mays
tgttagccacaaaccaaacat

SEQ ID NO: 3671 - DNA, 21 bp, Zea mays
atcttctttgccgagtgcctg

SEQ ID NO: 3672 - DNA, 21 bp, Zea mays
tccacatccaatggtgctgcg

SEQ ID NO: 3673 - DNA, 21 bp, Zea mays
gaataagacgagccagtcaag

SEQ ID NO: 3674 - DNA, 21 bp, Zea mays
tgagcacaccagcaaaaccga

SEQ ID NO: 3675 - DNA, 21 bp, Zea mays
tgcatgcaccggggcttgcct

SEQ ID NO: 3676 - DNA, 21 bp, Zea mays
ccgtctctgtgctgtccggtg

SEQ ID NO: 3677 - DNA, 21 bp, Zea mays
ctaatcaccaaatcagccctt

SEQ ID NO: 3678 - DNA, 21 bp, Zea mays
tctcccgcagcggttccccct

SEQ ID NO: 3679 - DNA, 21 bp, Zea mays
cacgccctaaggccctgttcg

SEQ ID NO: 3680 - DNA, 21 bp, Zea mays
taccagtggcttcggcaatac

SEQ ID NO: 3681 - DNA, 21 bp, Zea mays
gcacagtacgctttgtcgagt

SEQ ID NO: 3682 - DNA, 21 bp, Zea mays
ataacttgtcacactttgcct

SEQ ID NO: 3683 - DNA, 21 bp, Zea mays
cacgggcacggcacgattagc

SEQ ID NO: 3684 - DNA, 21 bp, Zea mays
gtcttccccaacccagcgggc

SEQ ID NO: 3685 - DNA, 21 bp, Zea mays
aggagaccgtcggacataagc

SEQ ID NO: 3686 - DNA, 21 bp, Zea mays
tccgtcgcaacgcacgggcac

SEQ ID NO: 3687 - DNA, 21 bp, Zea mays
tgagtgtccgtgcgttgcaac

SEQ ID NO: 3688 - DNA, 21 bp, Zea mays
tgcgagtgtcttcccagccct

SEQ ID NO: 3689 - DNA, 21 bp, Zea mays
gtgtgacgaccgttgaaactg

SEQ ID NO: 3690 - DNA, 21 bp, Zea mays
cgcgaagccgccgccgccgct

SEQ ID NO: 3691 - DNA, 21 bp, Zea mays
ctgtcctggctgtcccgcaac

SEQ ID NO: 3692 - DNA, 21 bp, Zea mays
gctgtttggtttctagggact

SEQ ID NO: 3693 - DNA, 21 bp, Zea mays
tgacacaaaccaaacaggccc

SEQ ID NO: 3694 - DNA, 21 bp, Zea mays
attgcaaccggaatcgttcca

SEQ ID NO: 3695 - DNA, 21 bp, Zea mays
gacgcacacggaccacgcgac

SEQ ID NO: 3696 - DNA, 21 bp, Zea mays
gtgcagcccggatgcaaacca

SEQ ID NO: 3697 - DNA, 21 bp, Zea mays
aatagacggtgtcgcaacacc

SEQ ID NO: 3698 - DNA, 21 bp, Zea mays
gctctgcctgcctgcctgcct

SEQ ID NO: 3699 - DNA, 21 bp, Zea mays
gataaatgggtcggcacgacg

SEQ ID NO: 3700 - DNA, 21 bp, Zea mays
gagcctcccaaactagccctc

SEQ ID NO: 3701 - DNA, 21 bp, Zea mays
gaaagcagcggagaactcacg

SEQ ID NO: 3702 - DNA, 21 bp, Zea mays
atatagaggacgttgctggag

SEQ ID NO: 3703 - DNA, 21 bp, Zea mays
aataagacgtctgttgctact

SEQ ID NO: 3704 - DNA, 21 bp, Zea mays
aagccaagtcgaccccaagcg

SEQ ID NO: 3705 - DNA, 21 bp, Zea mays
agtccgggtcacatcaagcgt

SEQ ID NO: 3706 - DNA, 21 bp, Zea mays
tcagcgaaccaaacagaccct

SEQ ID NO: 3707 - DNA, 21 bp, Zea mays
gcaccttaggcagcaaaccag

SEQ ID NO: 3708 - DNA, 21 bp, Zea mays
aggcgcaacattcgcaccctc

SEQ ID NO: 3709 - DNA, 21 bp, Zea mays
atatagggcctgtttggttca

SEQ ID NO: 3710 - DNA, 21 bp, Zea mays
cacaactctggctcaggcacg

SEQ ID NO: 3711 - DNA, 21 bp, Zea mays
tctccaaggtgaacagcctct

SEQ ID NO: 3712 - DNA, 21 bp, Zea mays
ccccgttgcaacgcacgggca

SEQ ID NO: 3713 - DNA, 21 bp, Zea mays
cccaaacccgcccgcgaccac

SEQ ID NO: 3714 - DNA, 21 bp, Zea mays
agccgcaacattcgcaccctc

SEQ ID NO: 3715 - DNA, 21 bp, Zea mays
atatgtttggttccataggac

SEQ ID NO: 3716 - DNA, 21 bp, Zea mays
catagatcttggcgccgagct

SEQ ID NO: 3717 - DNA, 21 bp, Zea mays
cacagccggattgcagccgca

SEQ ID NO: 3718 - DNA, 21 bp, Zea mays
taggtgagtgtccgtacgttg

SEQ ID NO: 3719 - DNA, 21 bp, Zea mays
gtttgattgcatgcttgcacc

SEQ ID NO: 3720 - DNA, 21 bp, Zea mays
caggtcggtcggtcggtcggt

SEQ ID NO: 3721 - DNA, 21 bp, Zea mays
cctggctgcttctgtggactg

SEQ ID NO: 3722 - DNA, 21 bp, Zea mays
ccaagtcaatcgccgccgagt

SEQ ID NO: 3723 - DNA, 21 bp, Zea mays
tatatgcccgtgcgttgctac

SEQ ID NO: 3724 - DNA, 21 bp, Zea mays
agttttgccgagtgtcaaaaa

SEQ ID NO: 3725 - DNA, 21 bp, Zea mays
tgtggcgcggtgtggcgtctg

SEQ ID NO: 3726 - DNA, 21 bp, Zea mays
cagctcagctcggctcggctc

SEQ ID NO: 3727 - DNA, 21 bp, Zea mays
ccggtcgatccgtgcgaagac

SEQ ID NO: 3728 - DNA, 21 bp, Zea mays
cacggtgctggacgccttggg

SEQ ID NO: 3729 - DNA, 21 bp, Zea mays
gaaccgctgtagagcgtggag

SEQ ID NO: 3730 - DNA, 21 bp, Zea mays
actcacgtgccacgtcagcgt

SEQ ID NO: 3731 - DNA, 21 bp, Zea mays
gattcctggtcaccaaatcag

SEQ ID NO: 3732 - DNA, 21 bp, Zea mays
accggcgggcagcgggagcca

SEQ ID NO: 3733 - DNA, 21 bp, Zea mays
gattgattgcatgcttgcacc

SEQ ID NO: 3734 - DNA, 21 bp, Zea mays
aactagaaaccaaacaccccc

SEQ ID NO: 3735 - DNA, 21 bp, Zea mays
catagggcttgtttggtttgt

SEQ ID NO: 3736 - DNA, 21 bp, Zea mays
ttagaggggctaaaatcacct

SEQ ID NO: 3737 - DNA, 21 bp, Zea mays
cgagaaaaccggaggggattg

SEQ ID NO: 3738 - DNA, 21 bp, Zea mays
tttgtcaccaaatcagccctt

SEQ ID NO: 3739 - DNA, 21 bp, Zea mays
tgaggccttgttcgtttgtgt

SEQ ID NO: 3740 - DNA, 21 bp, Zea mays
acaggaccgtcggacataagc

SEQ ID NO: 3741 - DNA, 21 bp, Zea mays
ccccttacctccgacggcctc

SEQ ID NO: 3742 - DNA, 21 bp, Zea mays
gccgagcagcaggcatccaat

SEQ ID NO: 3743 - DNA, 21 bp, Zea mays
tgctcgtcttcctgcctccac

SEQ ID NO: 3744 - DNA, 21 bp, Zea mays
cgccaatcggcccccaagaac

SEQ ID NO: 3745 - DNA, 21 bp, Zea mays
aatcgcgggctgggccgtgct

SEQ ID NO: 3746 - DNA, 21 bp, Zea mays
agccgtgtcgggccgtgcttt

SEQ ID NO: 3747 - DNA, 21 bp, Zea mays
ctataggcagaaccgtgcacc

SEQ ID NO: 3748 - DNA, 21 bp, Zea mays
tacgtcctcgtgccggagcaa

SEQ ID NO: 3749 - DNA, 21 bp, Zea mays
caacccgagagcggatggggt

SEQ ID NO: 3750 - DNA, 21 bp, Zea mays
gactatgggcctgtttggttc

SEQ ID NO: 3751 - DNA, 21 bp, Zea mays
ggcacgaaccaaacaggccca

SEQ ID NO: 3752 - DNA, 21 bp, Zea mays
ggcctcgtctcctccggatcg

SEQ ID NO: 3753 - DNA, 21 bp, Zea mays
gcctcgggcgggcgggcgggc

SEQ ID NO: 3754 - DNA, 21 bp, Zea mays
cggcagcatcccccttgcaaa

SEQ ID NO: 3755 - DNA, 21 bp, Zea mays
gactgcacccggaatcgttcc

SEQ ID NO: 3756 - DNA, 21 bp, Zea mays
tcttggtgctgttgggatttg

SEQ ID NO: 3757 - DNA, 21 bp, Zea mays
caaagcgagccgagccgagct

SEQ ID NO: 3758 - DNA, 21 bp, Zea mays
ccggagccagccagccagcca

SEQ ID NO: 3759 - DNA, 21 bp, Zea mays
ggtcctgtttgggatagctcc

SEQ ID NO: 3760 - DNA, 21 bp, Zea mays
tcagggcttaaccgaacgcac

SEQ ID NO: 3761 - DNA, 21 bp, Zea mays
gccctggcactcggcaaagag

SEQ ID NO: 3762 - DNA, 21 bp, Zea mays
ctccgttgcaacgcacgggca

SEQ ID NO: 3763 - DNA, 21 bp, Zea mays
gcttgagtacctcgccgccga

SEQ ID NO: 3764 - DNA, 21 bp, Zea mays
tcggtgcacgagcatcgcagc

SEQ ID NO: 3765 - DNA, 21 bp, Zea mays
gttagtgcccgtgcgttgcaa

SEQ ID NO: 3766 - DNA, 21 bp, Zea mays
agccaccgttccttagctccg

SEQ ID NO: 3767 - DNA, 21 bp, Zea mays
gtatagtgccggcacggcacg

SEQ ID NO: 3768 - DNA, 21 bp, Zea mays
ctctgtttgcagcccctcaca

SEQ ID NO: 3769 - DNA, 21 bp, Zea mays
ccgtcctgtcattgcaaccaa

SEQ ID NO: 3770 - DNA, 21 bp, Zea mays
tcgatgtggccgcttcacccg

SEQ ID NO: 3771 - DNA, 21 bp, Zea mays
aagggggggggggggggggtg

SEQ ID NO: 3772 - DNA, 21 bp, Zea mays
agtggagcaaccgtactggac

SEQ ID NO: 3773 - DNA, 21 bp, Zea mays
aacattaagttcgacggtacc

SEQ ID NO: 3774 - DNA, 21 bp, Zea mays
gatgcttctttgccgagtgcc

SEQ ID NO: 3775 - DNA, 21 bp, Zea mays
aaattctttgccgagtgctgt

SEQ ID NO: 3776 - DNA, 21 bp, Zea mays
ggccctgtttgggatagctcc

SEQ ID NO: 3777 - DNA, 21 bp, Zea mays
tcgtcctgtcattgcaaccaa

SEQ ID NO: 3778 - DNA, 21 bp, Zea mays
cagtgtttggttcgtggctaa

SEQ ID NO: 3779 - DNA, 21 bp, Zea mays
gcctattttcggcggttcctg

SEQ ID NO: 3780 - DNA, 21 bp, Zea mays
agacttagcctccaagcgacc

SEQ ID NO: 3781 - DNA, 21 bp, Zea mays
ctttagggcctgtttggttca

SEQ ID NO: 3782 - DNA, 21 bp, Zea mays
tctggccttgttcgtttgtgt

SEQ ID NO: 3783 - DNA, 21 bp, Zea mays
cagagtctgttggattagcct

SEQ ID NO: 3784 - DNA, 21 bp, Zea mays
tgggggtgggtgggtgggtgg

SEQ ID NO: 3785 - DNA, 21 bp, Zea mays
cgaaatttggctctttgccga

SEQ ID NO: 3786 - DNA, 21 bp, Zea mays
agcgtgcctgcctgcctgcct

SEQ ID NO: 3787 - DNA, 21 bp, Zea mays
ccagcccctccaatcccctcc

SEQ ID NO: 3788 - DNA, 21 bp, Zea mays
ggcacaaacgaacaaggcctg

SEQ ID NO: 3789 - DNA, 21 bp, Zea mays
catggtcaccaaatcagccct

SEQ ID NO: 3790 - DNA, 21 bp, Zea mays
agacgtacgtgtggatgcagc

SEQ ID NO: 3791 - DNA, 21 bp, Zea mays
gcacggcccaagcacggcacg

SEQ ID NO: 3792 - DNA, 21 bp, Zea mays
attagccacgaaccaaacagg

SEQ ID NO: 3793 - DNA, 21 bp, Zea mays
gggaaccgctgaagacagtct

SEQ ID NO: 3794 - DNA, 21 bp, Zea mays
cgtgggagagggcactgccgc

SEQ ID NO: 3795 - DNA, 21 bp, Zea mays
tatgggtggggcaggggttcg

SEQ ID NO: 3796 - DNA, 21 bp, Zea mays
tcgtggtcgttctcacatggg

SEQ ID NO: 3797 - DNA, 21 bp, Zea mays
ttttacatcacaggcggttcg

SEQ ID NO: 3798 - DNA, 21 bp, Zea mays
ctaaccgaaccgcctgtgatg

SEQ ID NO: 3799 - DNA, 21 bp, Zea mays
gcgcctcctcggtcaccgcct

SEQ ID NO: 3800 - DNA, 21 bp, Zea mays
gtgacgcacgggcactcacct

SEQ ID NO: 3801 - DNA, 21 bp, Zea mays
gtgtcgggccagcctgttagc

SEQ ID NO: 3802 - DNA, 21 bp, Zea mays
tgtaggctcggcccgtaggcc

SEQ ID NO: 3803 - DNA, 21 bp, Zea mays
gtgtcgtcgcaacgcacgggc

SEQ ID NO: 3804 - DNA, 21 bp, Zea mays
ggccacgcagccagccagcct

SEQ ID NO: 3805 - DNA, 21 bp, Zea mays
cttctttgccgagtgcttttt

SEQ ID NO: 3806 - DNA, 21 bp, Zea mays
tcttgtcaccaaatcagccct

SEQ ID NO: 3807 - DNA, 21 bp, Zea mays
gacgccgtcgtcgttgtctgc

SEQ ID NO: 3808 - DNA, 21 bp, Zea mays
tagtcgtgctcaggctgggtt

SEQ ID NO: 3809 - DNA, 21 bp, Zea mays
acacatatctgatcggatctt

SEQ ID NO: 3810 - DNA, 21 bp, Zea mays
ctatactaccactgtcttttt

SEQ ID NO: 3811 - DNA, 21 bp, Zea mays
aaaaaagagttgcaaaactag

SEQ ID NO: 3812 - DNA, 21 bp, Zea mays
aaaccacttcaatactagagt

SEQ ID NO: 3813 - DNA, 21 bp, Zea mays
tttataattagtttgaccttt

SEQ ID NO: 3814 - DNA, 21 bp, Zea mays
taaatcctgcgcgaagtccac

SEQ ID NO: 3815 - DNA, 21 bp, Zea mays
aaattagtcgaaaccagatcc

SEQ ID NO: 3816 - DNA, 21 bp, Zea mays
tgagctggaatgaatcctgac

SEQ ID NO: 3817 - DNA, 21 bp, Zea mays
tgatagtcacacatcacaggt

SEQ ID NO: 3818 - DNA, 21 bp, Zea mays
aatccggttaggaatcgttcc

SEQ ID NO: 3819 - DNA, 21 bp, Zea mays
cgggcgcaaccagccgacaac

SEQ ID NO: 3820 - DNA, 21 bp, Zea mays
ctagagggcatgagccaaaaa

SEQ ID NO: 3821 - DNA, 21 bp, Zea mays
gatagatcaaaatatggagtg

SEQ ID NO: 3822 - DNA, 21 bp, Zea mays
gtgtcgaagtcagtgctggac

SEQ ID NO: 3823 - DNA, 21 bp, Zea mays
caaatcctgcgcgaagtccac

SEQ ID NO: 3824 - DNA, 21 bp, Zea mays
cagatcctgcgcgaagtccac

SEQ ID NO: 3825 - DNA, 21 bp, Zea mays
ctctatatatagtgcaaagtt

SEQ ID NO: 3826 - DNA, 21 bp, Zea mays
cagccaaggatgacttgccga

SEQ ID NO: 3827 - DNA, 21 bp, Zea mays
ttcgacgccatagcctatagc

SEQ ID NO: 3828 - DNA, 21 bp, Zea mays
tgcactagaactagtagttag

SEQ ID NO: 3829 - DNA, 21 bp, Zea mays
tatagatcaaaatatggagtg

SEQ ID NO: 3830 - DNA, 21 bp, Zea mays
ttgagccgcgtcaatatctcc

SEQ ID NO: 3831 - DNA, 21 bp, Zea mays
ggagatattgacgcggctcaa

SEQ ID NO: 3832 - DNA, 21 bp, Zea mays
ttttgtgcctaaggttagttc

SEQ ID NO: 3833 - DNA, 21 bp, Zea mays
ggacaaatcagcgacataaac

SEQ ID NO: 3834 - DNA, 21 bp, Zea mays
tctaccctccaaatgtagcgg

SEQ ID NO: 3835 - DNA, 21 bp, Zea mays
ccaatcctgcgcgaagtccac

SEQ ID NO: 3836 - DNA, 21 bp, Zea mays
gcagtagaggcgcaagaagat

SEQ ID NO: 3837 - DNA, 21 bp, Zea mays
ccaagggattgatgtgatctt

SEQ ID NO: 3838 - DNA, 21 bp, Zea mays
cagccggactaagcacaacaa

SEQ ID NO: 3839 - DNA, 21 bp, Zea mays
gcaccacgcgcaggcttagct

SEQ ID NO: 3840 - DNA, 21 bp, Zea mays
ccaagcgcgatgaccaattgt

SEQ ID NO: 3841 - DNA, 21 bp, Zea mays
cagtccgagaagggcaagaga

SEQ ID NO: 3842 - DNA, 21 bp, Zea mays
tcagaggcccaaccctatatc

SEQ ID NO: 3843 - DNA, 21 bp, Zea mays
gtcggacataatgctatttcc

SEQ ID NO: 3844 - DNA, 21 bp, Zea mays
ggctatggtataggcgtccac

SEQ ID NO: 3845 - DNA, 21 bp, Zea mays
ccagaggcccaaccctatatc

SEQ ID NO: 3846 - DNA, 21 bp, Zea mays
cctctaaatttagaggaccgt

SEQ ID NO: 3847 - DNA, 21 bp, Zea mays
ccacctcacgcacgaatgcgg

SEQ ID NO: 3848 - DNA, 21 bp, Zea mays
caaatagatagagaaccgttt

SEQ ID NO: 3849 - DNA, 21 bp, Zea mays
ccgcgaacacggcaaggattc

SEQ ID NO: 3850 - DNA, 21 bp, Zea mays
cacatcaagcgtttgactttt

SEQ ID NO: 3851 - DNA, 21 bp, Zea mays
catctgggcgagcgacatgcc

SEQ ID NO: 3852 - DNA, 21 bp, Zea mays
gatctgggcgagcgacatgcc

SEQ ID NO: 3853 - DNA, 21 bp, Zea mays
aatctgggcgagcgacatgcc

SEQ ID NO: 3854 - DNA, 21 bp, Zea mays
ttatttcgtgccgggctcgtg

SEQ ID NO: 3855 - DNA, 21 bp, Zea mays
gcctatggcgccgagcatcgg

SEQ ID NO: 3856 - DNA, 21 bp, Zea mays
gcccctgaggcgtgacttagg

SEQ ID NO: 3857 - DNA, 21 bp, Zea mays
gtctacatagtgtaggaacat

SEQ ID NO: 3858 - DNA, 21 bp, Zea mays
gcgaccttggctatcaactac

SEQ ID NO: 3859 - DNA, 21 bp, Zea mays
tatactttgccgagtgccttt

SEQ ID NO: 3860 - DNA, 21 bp, Zea mays
agactccgcccgctggcttac

SEQ ID NO: 3861 - DNA, 21 bp, Zea mays
catgttaggttctttgccgag

SEQ ID NO: 3862 - DNA, 21 bp, Zea mays
cccccagcgcttacaggctca

SEQ ID NO: 3863 - DNA, 21 bp, Zea mays
cctacgtggcagccgatgtgg

SEQ ID NO: 3864 - DNA, 21 bp, Zea mays
gttggcactcggcaaagactg

SEQ ID NO: 3865 - DNA, 21 bp, Zea mays
ttggcactcggcaaagtctgt

SEQ ID NO: 3866 - DNA, 21 bp, Zea mays
actcggaatcgttccagctaa

SEQ ID NO: 3867 - DNA, 21 bp, Zea mays
cgcaaccgcccttcgtcgtcg

SEQ ID NO: 3868 - DNA, 21 bp, Zea mays
gtggctcccaaactagcccta

SEQ ID NO: 3869 - DNA, 21 bp, Zea mays
cgtggatcagcccggtctgga

SEQ ID NO: 3870 - DNA, 21 bp, Zea mays
aggaggaccgacaacaatgac

SEQ ID NO: 3871 - DNA, 21 bp, Zea mays
gggaccactaccgcagcatca

SEQ ID NO: 3872 - DNA, 21 bp, Zea mays
ccacggcgaagactgcgccca

SEQ ID NO: 3873 - DNA, 21 bp, Zea mays
tccacgagcacgtttcggcct

SEQ ID NO: 3874 - DNA, 21 bp, Zea mays
tggcctttcgccgagcacttg

SEQ ID NO: 3875 - DNA, 21 bp, Zea mays
atatgaagaagcaacaacaac

SEQ ID NO: 3876 - DNA, 21 bp, Zea mays
acaaaccaacatgggtctttt

SEQ ID NO: 3877 - DNA, 21 bp, Zea mays
agtcactatgaggtcttcgac

SEQ ID NO: 3878 - DNA, 21 bp, Zea mays
acgcaccaggtccaaaatgtc

SEQ ID NO: 3879 - DNA, 21 bp, Zea mays
atcggcacgccagccgtccgc

SEQ ID NO: 3880 - DNA, 21 bp, Zea mays
agatcggcggcactcggcaaa

SEQ ID NO: 3881 - DNA, 21 bp, Zea mays
ttgaacccgttcggtctccct

SEQ ID NO: 3882 - DNA, 21 bp, Zea mays
tgacagaaacgaacaaggcct

SEQ ID NO: 3883 - DNA, 21 bp, Zea mays
tgttagtggccttgtcggact

SEQ ID NO: 3884 - DNA, 21 bp, Zea mays
tatttggttgcctgcacaagg

SEQ ID NO: 3885 - DNA, 21 bp, Zea mays
attcccgtcgcaacgcacggg

SEQ ID NO: 3886 - DNA, 21 bp, Zea mays
ggagacactcggcaaagacgt

SEQ ID NO: 3887 - DNA, 21 bp, Zea mays
aaacactatgaggtcttcgac

SEQ ID NO: 3888 - DNA, 21 bp, Zea mays
ctgtctgataggcttcggcct

SEQ ID NO: 3889 - DNA, 21 bp, Zea mays
agtttctttgccgagtgtttt

SEQ ID NO: 3890 - DNA, 21 bp, Zea mays
agagtctttgccgagtgtttt

SEQ ID NO: 3891 - DNA, 21 bp, Zea mays
gcagtctcgaagtcaaaccaa

SEQ ID NO: 3892 - DNA, 21 bp, Zea mays
attatgtccgacggctgtcgt

SEQ ID NO: 3893 - DNA, 21 bp, Zea mays
gttctttgccgagtgctatgg

SEQ ID NO: 3894 - DNA, 21 bp, Zea mays
ttggatagcctgcttcactct

SEQ ID NO: 3895 - DNA, 21 bp, Zea mays
gcggttatgagtacgaccggg

SEQ ID NO: 3896 - DNA, 21 bp, Zea mays
aggcactcggcaaagaggtcg

SEQ ID NO: 3897 - DNA, 21 bp, Zea mays
acctcggcgccatagatcttg

SEQ ID NO: 3898 - DNA, 21 bp, Zea mays
gctcggcgccacagatcttga

SEQ ID NO: 3899 - DNA, 21 bp, Zea mays
tctggcactcggcaaagactg

SEQ ID NO: 3900 - DNA, 21 bp, Zea mays
actcagtcggcagcaagagct

SEQ ID NO: 3901 - DNA, 21 bp, Zea mays
tcgatgacagcacggtctcca

SEQ ID NO: 3902 - DNA, 21 bp, Zea mays
tgcttctttgtcgagtgccag

SEQ ID NO: 3903 - DNA, 21 bp, Zea mays
accaagtcgtggtcacatctt

SEQ ID NO: 3904 - DNA, 21 bp, Zea mays
taaatggaccacccgctgggt

SEQ ID NO: 3905 - DNA, 21 bp, Zea mays
ctgcctcgcgaactcctcgtc

SEQ ID NO: 3906 - DNA, 21 bp, Zea mays
agccgaggcgattgccgcctt

SEQ ID NO: 3907 - DNA, 21 bp, Zea mays
tggcactcggcaaagtctttg

SEQ ID NO: 3908 - DNA, 21 bp, Zea mays
agacgggccttttcgggcttg

SEQ ID NO: 3909 - DNA, 21 bp, Zea mays
aactgcggcgggaaaagtgtg

SEQ ID NO: 3910 - DNA, 21 bp, Zea mays
taaggttagtcgttcgaattg

SEQ ID NO: 3911 - DNA, 21 bp, Zea mays
cgatctccactgcgcgcacct

SEQ ID NO: 3912 - DNA, 21 bp, Zea mays
tgcaataatgcacatgaatgc

SEQ ID NO: 3913 - DNA, 21 bp, Zea mays
taacttctttgccgagtgcct

SEQ ID NO: 3914 - DNA, 21 bp, Zea mays
atctccgccgttcaacccaga

SEQ ID NO: 3915 - DNA, 21 bp, Zea mays
ccctgcactcagtcgtgttca

SEQ ID NO: 3916 - DNA, 21 bp, Zea mays
catccaaccaaacacatccta

SEQ ID NO: 3917 - DNA, 21 bp, Zea mays
accacagggtcctcgaccttg

SEQ ID NO: 3918 - DNA, 21 bp, Zea mays
cgcccgtgctgcggcgtacac

SEQ ID NO: 3919 - DNA, 21 bp, Zea mays
cttttttgccgagtgctatgg

SEQ ID NO: 3920 - DNA, 21 bp, Zea mays
ctcagcgtcataggctatggc

SEQ ID NO: 3921 - DNA, 21 bp, Zea mays
cacgggcactcggcaaagaaa

SEQ ID NO: 3922 - DNA, 21 bp, Zea mays
gctggacactcggcaaagcct

SEQ ID NO: 3923 - DNA, 21 bp, Zea mays
atggtatcagagccgaccctc

SEQ ID NO: 3924 - DNA, 21 bp, Zea mays
gcccaccggcacttaacacca

SEQ ID NO: 3925 - DNA, 21 bp, Zea mays
tagccgtcggacataagctta

SEQ ID NO: 3926 - DNA, 21 bp, Zea mays
ggtcccgttgcaacgcacggg

SEQ ID NO: 3927 - DNA, 21 bp, Zea mays
ataaggtcttgttcgtttgtg

SEQ ID NO: 3928 - DNA, 21 bp, Zea mays
cctcccaagttattgggccca

SEQ ID NO: 3929 - DNA, 21 bp, Zea mays
tgccaggaccagccgatccat

SEQ ID NO: 3930 - DNA, 21 bp, Zea mays
ccttggcgccgtagatcttgg

SEQ ID NO: 3931 - DNA, 21 bp, Zea mays
acaagtcattcaggcttacac

SEQ ID NO: 3932 - DNA, 21 bp, Zea mays
cgatcatcgacaacggcctct

SEQ ID NO: 3933 - DNA, 21 bp, Zea mays
agattcgtggggcgggtacac

SEQ ID NO: 3934 - DNA, 21 bp, Zea mays
taagccgtcgcaacgcacggg

SEQ ID NO: 3935 - DNA, 21 bp, Zea mays
gtgcagtcatcccgagggagt

SEQ ID NO: 3936 - DNA, 21 bp, Zea mays
aggctccgcccgctggcttac

SEQ ID NO: 3937 - DNA, 21 bp, Zea mays
acagaccaacacgagtctttt

SEQ ID NO: 3938 - DNA, 21 bp, Zea mays
tggcactgagccgcttcaggg

SEQ ID NO: 3939 - DNA, 21 bp, Zea mays
ggtacccacgttcctaatacg

SEQ ID NO: 3940 - DNA, 21 bp, Zea mays
cagatcgccgtggtttggccg

SEQ ID NO: 3941 - DNA, 21 bp, Zea mays
tcccggaatcgttccagctaa

SEQ ID NO: 3942 - DNA, 21 bp, Zea mays
cttaggtcttgttcgtttgtg

SEQ ID NO: 3943 - DNA, 21 bp, Zea mays
cctatcgagcaactcagcaag

SEQ ID NO: 3944 - DNA, 21 bp, Zea mays
cctgtttggcacagcttattt

SEQ ID NO: 3945 - DNA, 21 bp, Zea mays
cttacgtggcagccgatgtgg

SEQ ID NO: 3946 - DNA, 21 bp, Zea mays
gtgctgctggtgtagatgtgc

SEQ ID NO: 3947 - DNA, 21 bp, Zea mays
cctgcaaccaaacacatccta

SEQ ID NO: 3948 - DNA, 21 bp, Zea mays
tgctcggcgccatagcctatg

SEQ ID NO: 3949 - DNA, 21 bp, Zea mays
ggccacacaccaaactagcct

SEQ ID NO: 3950 - DNA, 21 bp, Zea mays
actcagtcatcccgagggagt

SEQ ID NO: 3951 - DNA, 21 bp, Zea mays
atgaatccattttcctgtcca

SEQ ID NO: 3952 - DNA, 21 bp, Zea mays
cggcactatgaggtcttcgac

SEQ ID NO: 3953 - DNA, 21 bp, Zea mays
gatacaaacgaacaaggcctt

SEQ ID NO: 3954 - DNA, 21 bp, Zea mays
tggtgcagacactcggcaaag

SEQ ID NO: 3955 - DNA, 21 bp, Zea mays
gggctctttgccgagtgtcac

SEQ ID NO: 3956 - DNA, 21 bp, Zea mays
cttttccaccctctagccaac

SEQ ID NO: 3957 - DNA, 21 bp, Zea mays
tctgtagtgccagtcactgaa

SEQ ID NO: 3958 - DNA, 21 bp, Zea mays
ggtgtttgggaacaaagtttt

SEQ ID NO: 3959 - DNA, 21 bp, Zea mays
ggctttattttaattcccgtc

SEQ ID NO: 3960 - DNA, 21 bp, Zea mays
ccgagcgcagactagccacgg

SEQ ID NO: 3961 - DNA, 21 bp, Zea mays
taggttattttcggcggcttc

SEQ ID NO: 3962 - DNA, 21 bp, Zea mays
gtggttattttcggcggcttc

SEQ ID NO: 3963 - DNA, 21 bp, Zea mays
cactctcctctcatccatgac

SEQ ID NO: 3964 - DNA, 21 bp, Zea mays
tctttgccgtgtgtctgagac

SEQ ID NO: 3965 - DNA, 21 bp, Zea mays
cctttgccgtgtgtctcagac

SEQ ID NO: 3966 - DNA, 21 bp, Zea mays
caaatggcactcggcaaagaa

SEQ ID NO: 3967 - DNA, 21 bp, Zea mays
ggatgttcgccgccaagatct

SEQ ID NO: 3968 - DNA, 21 bp, Zea mays
atgggtacccacgttcctaac

SEQ ID NO: 3969 - DNA, 21 bp, Zea mays
gaatgctgagccccgacatgt

SEQ ID NO: 3970 - DNA, 21 bp, Zea mays
aattggtctcaaccaaagttt

SEQ ID NO: 3971 - DNA, 21 bp, Zea mays
gaccaaagccgtcggacataa

SEQ ID NO: 3972 - DNA, 21 bp, Zea mays
taagcttagacaaagtgtggc

SEQ ID NO: 3973 - DNA, 21 bp, Zea mays
cctcacttgccacactttgcc

SEQ ID NO: 3974 - DNA, 21 bp, Zea mays
cccatcgccgtggtttggccg

SEQ ID NO: 3975 - DNA, 21 bp, Zea mays
aatactttgccgagtgccttt

SEQ ID NO: 3976 - DNA, 21 bp, Zea mays
ttttctttgtcgagtgctttt

SEQ ID NO: 3977 - DNA, 21 bp, Zea mays
aaaaggtcttgttcgtttgtg

SEQ ID NO: 3978 - DNA, 21 bp, Zea mays
cctgggccttaagtaaggtct

SEQ ID NO: 3979 - DNA, 21 bp, Zea mays
gtgactcccaaactagcccta

SEQ ID NO: 3980 - DNA, 21 bp, Zea mays
gcgtcacgatgcccgatcttc

SEQ ID NO: 3981 - DNA, 21 bp, Zea mays
tctgttccagcagaaacgaac

SEQ ID NO: 3982 - DNA, 21 bp, Zea mays
ctggcactatactaaccggac

SEQ ID NO: 3983 - DNA, 21 bp, Zea mays
ttgcatttcgccgacactcgg

SEQ ID NO: 3984 - DNA, 21 bp, Zea mays
attgcgtcagcatcctcgagg

SEQ ID NO: 3985 - DNA, 21 bp, Zea mays
gcaaagacgcaattggcccag

SEQ ID NO: 3986 - DNA, 21 bp, Zea mays
gtcctaatccgactgcggctg

SEQ ID NO: 3987 - DNA, 21 bp, Zea mays
aagtgcgcacaaaagactcgt

SEQ ID NO: 3988 - DNA, 21 bp, Zea mays
acgtcgctagatggcggagac

SEQ ID NO: 3989 - DNA, 21 bp, Zea mays
agcggggcgcgatctggttga

SEQ ID NO: 3990 - DNA, 21 bp, Zea mays
gtttgacttctgcgcagtctt

SEQ ID NO: 3991 - DNA, 21 bp, Zea mays
catcttaggccttgttcgttt

SEQ ID NO: 3992 - DNA, 21 bp, Zea mays
ggtgcttccaaacagggccta

SEQ ID NO: 3993 - DNA, 21 bp, Zea mays
aatcgcgttctttgccgagtg

SEQ ID NO: 3994 - DNA, 21 bp, Zea mays
aagtactcggcaaagaaggct

SEQ ID NO: 3995 - DNA, 21 bp, Zea mays
aaagctgacagaagagagtga

SEQ ID NO: 3996 - DNA, 21 bp, Zea mays
cgaaaaaaacactcggcaaag

SEQ ID NO: 3997 - DNA, 21 bp, Zea mays
agccagagccgaagctgaaaa

SEQ ID NO: 3998 - DNA, 21 bp, Zea mays
aacgagcacagtccgccgcat

SEQ ID NO: 3999 - DNA, 21 bp, Zea mays
aagcaggcttagtgccgtgct

SEQ ID NO: 4000 - DNA, 21 bp, Zea mays
ccaccagcgcttacaggctca

SEQ ID NO: 4001 - DNA, 21 bp, Zea mays
tcgtgccacgccttcggtcca

SEQ ID NO: 4002 - DNA, 21 bp, Zea mays
taggtcgccgtggtttggccg

SEQ ID NO: 4003 - DNA, 21 bp, Zea mays
ataagaacgtgggtacccacg

SEQ ID NO: 4004 - DNA, 21 bp, Zea mays
tagatcgccgtggtttggccg

SEQ ID NO: 4005 - DNA, 21 bp, Zea mays
gccacaccaggaggacgacgc

SEQ ID NO: 4006 - DNA, 21 bp, Zea mays
aacggctggcactcggcaaag

SEQ ID NO: 4007 - DNA, 21 bp, Zea mays
ggccgtctctaggaagttagc

SEQ ID NO: 4008 - DNA, 21 bp, Zea mays
tttctttgccgagtgctatgg

SEQ ID NO: 4009 - DNA, 21 bp, Zea mays
cttctttgccgagtgctatgg

SEQ ID NO: 4010 - DNA, 21 bp, Zea mays
taatccgaccaatcttgcttg

SEQ ID NO: 4011 - DNA, 21 bp, Zea mays
ctgtaacgcacggacactcac

SEQ ID NO: 4012 - DNA, 21 bp, Zea mays
cttggtcggttagatctagat

SEQ ID NO: 4013 - DNA, 21 bp, Zea mays
cgcagctcggcgccaagatct

SEQ ID NO: 4014 - DNA, 21 bp, Zea mays
ttgcttctttgccgagtgcca

SEQ ID NO: 4015 - DNA, 21 bp, Zea mays
cacagcgtcagggccttcgca

SEQ ID NO: 4016 - DNA, 21 bp, Zea mays
tccttaggctggcatctcggc

SEQ ID NO: 4017 - DNA, 21 bp, Zea mays
atgcacgccgtctgcaggatg

SEQ ID NO: 4018 - DNA, 21 bp, Zea mays
tgtcactgagccgcttcaggg

SEQ ID NO: 4019 - DNA, 21 bp, Zea mays
caccacactcggcaaagaagc

SEQ ID NO: 4020 - DNA, 21 bp, Zea mays
tccaatagccgtgccgggctt

SEQ ID NO: 4021 - DNA, 21 bp, Zea mays
gccacgaaccaaacaggccat

SEQ ID NO: 4022 - DNA, 21 bp, Zea mays
atcgtcatcgtcgtcgtcgtc

SEQ ID NO: 4023 - DNA, 21 bp, Zea mays
ttgtccattgagcctgctctg

SEQ ID NO: 4024 - DNA, 21 bp, Zea mays
tcactcatccgagcctgctct

SEQ ID NO: 4025 - DNA, 21 bp, Zea mays
aactgacactcggcaaaggct

SEQ ID NO: 4026 - DNA, 21 bp, Zea mays
atccggaatcgttccagctaa

SEQ ID NO: 4027 - DNA, 21 bp, Zea mays
tatctggcactcggcaaagaa

SEQ ID NO: 4028 - DNA, 21 bp, Zea mays
gagcttctttgccgagtgcca

SEQ ID NO: 4029 - DNA, 21 bp, Zea mays
gctttggcactcggcaaagaa

SEQ ID NO: 4030 - DNA, 21 bp, Zea mays
gcatcatgtgcaccagtcttc

SEQ ID NO: 4031 - DNA, 21 bp, Zea mays
gagaccactaccgcagcatca

SEQ ID NO: 4032 - DNA, 21 bp, Zea mays
gaggtccccttcgctgaactc

SEQ ID NO: 4033 - DNA, 21 bp, Zea mays
caggccttgttcgtttgtgtc

SEQ ID NO: 4034 - DNA, 21 bp, Zea mays
acaggcaaatcatccctggct

SEQ ID NO: 4035 - DNA, 21 bp, Zea mays
gcttcaaacaccctgggttgc

SEQ ID NO: 4036 - DNA, 21 bp, Zea mays
gcaacgcacggtcactcacct

SEQ ID NO: 4037 - DNA, 21 bp, Zea mays
cctcggcgccgtagatcttgg

SEQ ID NO: 4038 - DNA, 21 bp, Zea mays
acgttggcactcggcaaagaa

SEQ ID NO: 4039 - DNA, 21 bp, Zea mays
tgcaagcttgccttcgcctca

SEQ ID NO: 4040 - DNA, 21 bp, Zea mays
gctgataagcactggcgaagt

SEQ ID NO: 4041 - DNA, 21 bp, Zea mays
gacctcgctgcgacttagttc

SEQ ID NO: 4042 - DNA, 21 bp, Zea mays
cctcggcgccaagatctatgg

SEQ ID NO: 4043 - DNA, 21 bp, Zea mays
tcagcactcggcaaagtcttt

SEQ ID NO: 4044 - DNA, 21 bp, Zea mays
tccggcatccgatggcttcca

SEQ ID NO: 4045 - DNA, 21 bp, Zea mays
acggagcaagcacatccggct

SEQ ID NO: 4046 - DNA, 21 bp, Zea mays
aggtgacactcggcaaaggct

SEQ ID NO: 4047 - DNA, 21 bp, Zea mays
gttttcaacggtcgtcatgcg

SEQ ID NO: 4048 - DNA, 21 bp, Zea mays
cggagcaatctcaccgccggt

SEQ ID NO: 4049 - DNA, 21 bp, Zea mays
atttgctccgataccagctgt

SEQ ID NO: 4050 - DNA, 21 bp, Zea mays
cgacactatgaggtcttcgac

SEQ ID NO: 4051 - DNA, 21 bp, Zea mays
gccctgcactcagtcgtgttt

SEQ ID NO: 4052 - DNA, 21 bp, Zea mays
aatcgtgcaagtaggtctctt

SEQ ID NO: 4053 - DNA, 21 bp, Zea mays
cctcgccgctatcgcttacac

SEQ ID NO: 4054 - DNA, 21 bp, Zea mays
ggttgcctctaggaagttagc

SEQ ID NO: 4055 - DNA, 21 bp, Zea mays
ttgctcatccgagcctgctct

SEQ ID NO: 4056 - DNA, 21 bp, Zea mays
ctctgcccagtccgtctcgcc

SEQ ID NO: 4057 - DNA, 21 bp, Zea mays
atctacgcaggacttcgccaa

SEQ ID NO: 4058 - DNA, 21 bp, Zea mays
gcgttagtccagcagacactc

SEQ ID NO: 4059 - DNA, 21 bp, Zea mays
aggtggcgggccgtcggacat

SEQ ID NO: 4060 - DNA, 21 bp, Zea mays
catgtggatagggccaagaac

SEQ ID NO: 4061 - DNA, 21 bp, Zea mays
agtggacactcggcaaaggct

SEQ ID NO: 4062 - DNA, 21 bp, Zea mays
ttgcataatgcacatgaatgc

SEQ ID NO: 4063 - DNA, 21 bp, Zea mays
tatctcgtcgtcaacctcgcc

SEQ ID NO: 4064 - DNA, 21 bp, Zea mays
cacccaaaatgctcctgattg

SEQ ID NO: 4065 - DNA, 21 bp, Zea mays
ggcgaagacgctgtctccgtc

SEQ ID NO: 4066 - DNA, 21 bp, Zea mays
ttaacactcggcaaaaagccg

SEQ ID NO: 4067 - DNA, 21 bp, Zea mays
aaaatgtttgcagcctctcac

SEQ ID NO: 4068 - DNA, 21 bp, Zea mays
tggacccacaacacagtgttt

SEQ ID NO: 4069 - DNA, 21 bp, Zea mays
ggcccgagtattttttggtcg

SEQ ID NO: 4070 - DNA, 21 bp, Zea mays
cttcgacggccaaagtcgtcg

SEQ ID NO: 4071 - DNA, 21 bp, Zea mays
gtgggtacccacgctcctaat

SEQ ID NO: 4072 - DNA, 21 bp, Zea mays
tgaccatctcacaccagcaga

SEQ ID NO: 4073 - DNA, 21 bp, Zea mays
ggtcttgttcgtttgcgtcgg

SEQ ID NO: 4074 - DNA, 21 bp, Zea mays
atggttccgttgcaacgcacg

SEQ ID NO: 4075 - DNA, 21 bp, Zea mays
ccgggcgtggacggaattcgg

SEQ ID NO: 4076 - DNA, 21 bp, Zea mays
gaaggtcattcaggcttacac

SEQ ID NO: 4077 - DNA, 21 bp, Zea mays
tggcactcggcaaagaaggct

SEQ ID NO: 4078 - DNA, 21 bp, Zea mays
tcaagtgaagacggagccagc

SEQ ID NO: 4079 - DNA, 21 bp, Zea mays
gcggcaccaaacatgtccagt

SEQ ID NO: 4080 - DNA, 21 bp, Zea mays
atatttagccacaaaccaaac

SEQ ID NO: 4081 - DNA, 21 bp, Zea mays
ggcattgttcgtttgcgtcgg

SEQ ID NO: 4082 - DNA, 21 bp, Zea mays
aggtggtgcatcatgggttca

SEQ ID NO: 4083 - DNA, 21 bp, Zea mays
ctggctcccaaactagcccta

SEQ ID NO: 4084 - DNA, 21 bp, Zea mays
tgccttctttgccgagtgctt

SEQ ID NO: 4085 - DNA, 21 bp, Zea mays
cttgacactcggcaaagaagc

SEQ ID NO: 4086 - DNA, 21 bp, Zea mays
ctaagacccaaggtcctgttt

SEQ ID NO: 4087 - DNA, 21 bp, Zea mays
cgtagcaacgcacgggcacat

SEQ ID NO: 4088 - DNA, 21 bp, Zea mays
ggacaaagccgtcggacataa

SEQ ID NO: 4089 - DNA, 21 bp, Zea mays
agctaagacctaggccgaaac

SEQ ID NO: 4090 - DNA, 21 bp, Zea mays
ccacgtcgtgtgtttaggttt

SEQ ID NO: 4091 - DNA, 21 bp, Zea mays
ggacactcggcaaagaggtcg

SEQ ID NO: 4092 - DNA, 21 bp, Zea mays
aggggcggttcaaccggtttt

SEQ ID NO: 4093 - DNA, 21 bp, Zea mays
ggcctatcctcatttttgtga

SEQ ID NO: 4094 - DNA, 21 bp, Zea mays
actatgtgttacctcggcgtc

SEQ ID NO: 4095 - DNA, 21 bp, Zea mays
acactcatccgagcctgctct

SEQ ID NO: 4096 - DNA, 21 bp, Zea mays
gactctactcagaagcactac

SEQ ID NO: 4097 - DNA, 21 bp, Zea mays
caccggacacagtagccgcag

SEQ ID NO: 4098 - DNA, 21 bp, Zea mays
tcgccgtacgaagtcgtcgcc

SEQ ID NO: 4099 - DNA, 21 bp, Zea mays
tgatacttactcctggcagct

SEQ ID NO: 4100 - DNA, 21 bp, Zea mays
ctctctcctctcatccatgac

SEQ ID NO: 4101 - DNA, 21 bp, Zea mays
ccgtgcagtaccagtcactga

SEQ ID NO: 4102 - DNA, 21 bp, Zea mays
tactacaccgtagtgggctgc

SEQ ID NO: 4103 - DNA, 21 bp, Zea mays
acggtgcaatccggtcgagcc

SEQ ID NO: 4104 - DNA, 21 bp, Zea mays
gtgaccactaccgcagcatca

SEQ ID NO: 4105 - DNA, 21 bp, Zea mays
agatctttgccgagtgctttt

SEQ ID NO: 4106 - DNA, 21 bp, Zea mays
caacacaaacgaacaaggcct

SEQ ID NO: 4107 - DNA, 21 bp, Zea mays
atgtctggccaagtcaccctc

SEQ ID NO: 4108 - DNA, 21 bp, Zea mays
caatttgtaggagtagtcggc

SEQ ID NO: 4109 - DNA, 21 bp, Zea mays
acaagctccgataccagctgt

SEQ ID NO: 4110 - DNA, 21 bp, Zea mays
agtcggactagagtcaagctc

SEQ ID NO: 4111 - DNA, 21 bp, Zea mays
ccgctcctgaaatcggtcgta

SEQ ID NO: 4112 - DNA, 21 bp, Zea mays
tctctcatccgagcctgctct

SEQ ID NO: 4113 - DNA, 21 bp, Zea mays
ggacaagcagctcgtcctcga

SEQ ID NO: 4114 - DNA, 21 bp, Zea mays
gtcttcgggagatctgcagag

SEQ ID NO: 4115 - DNA, 21 bp, Zea mays
aatcaaaaagcaacgtcgcta

SEQ ID NO: 4116 - DNA, 21 bp, Zea mays
gcctcggacgctagagtcaag

SEQ ID NO: 4117 - DNA, 21 bp, Zea mays
ctgaaaaacactcggcgaagt

SEQ ID NO: 4118 - DNA, 21 bp, Zea mays
tatggcattcggtgtcagctg

SEQ ID NO: 4119 - DNA, 21 bp, Zea mays
gatcgcagacactcggcaaag

SEQ ID NO: 4120 - DNA, 21 bp, Zea mays
tccagctggcactcggcaaag

SEQ ID NO: 4121 - DNA, 21 bp, Zea mays
ccctgctggcactcggcaaag

SEQ ID NO: 4122 - DNA, 21 bp, Zea mays
gtctcacttcgccagaccgcc

SEQ ID NO: 4123 - DNA, 21 bp, Zea mays
catttggcgcgccaggtaggg

SEQ ID NO: 4124 - DNA, 21 bp, Zea mays
caacgcacggacaaccgacta

SEQ ID NO: 4125 - DNA, 21 bp, Zea mays
tgcttaggccttgttcgtttc

SEQ ID NO: 4126 - DNA, 21 bp, Zea mays
tgattaccaacgcagcctgat

SEQ ID NO: 4127 - DNA, 21 bp, Zea mays
actctcctgcgtgttcgagaa

SEQ ID NO: 4128 - DNA, 21 bp, Zea mays
gccacgcctcgcagacttgct

SEQ ID NO: 4129 - DNA, 21 bp, Zea mays
ctcccatgcgcaaaatgcatc

SEQ ID NO: 4130 - DNA, 21 bp, Zea mays
ccgccgtacgaagtcgtcgcc

SEQ ID NO: 4131 - DNA, 21 bp, Zea mays
gtctccgttgcaacgcacggg

SEQ ID NO: 4132 - DNA, 21 bp, Zea mays
tcctgcgcgaagtccacagcg

SEQ ID NO: 4133 - DNA, 21 bp, Zea mays
atacgggccttttcgggcttg

SEQ ID NO: 4134 - DNA, 21 bp, Zea mays
cgtaggccctgtttggcacag

SEQ ID NO: 4135 - DNA, 21 bp, Zea mays
cgtccatccgaagtctcgaga

SEQ ID NO: 4136 - DNA, 21 bp, Zea mays
ctgatcagccgtatcgcggag

SEQ ID NO: 4137 - DNA, 21 bp, Zea mays
ggccgccggagcgtaacaccc

SEQ ID NO: 4138 - DNA, 21 bp, Zea mays
tcgtcacttgagggtcaaacc

SEQ ID NO: 4139 - DNA, 21 bp, Zea mays
tacggcaaccaatcaggccct

SEQ ID NO: 4140 - DNA, 21 bp, Zea mays
cacgtccatcaacggtcacat

SEQ ID NO: 4141 - DNA, 21 bp, Zea mays
tccgccttgccacaactgaag

SEQ ID NO: 4142 - DNA, 21 bp, Zea mays
atcctttgccgagtgctatgg

SEQ ID NO: 4143 - DNA, 21 bp, Zea mays
aaagacaacagttcctgccga

SEQ ID NO: 4144 - DNA, 21 bp, Zea mays
tcacggcgaagactgcgccca

SEQ ID NO: 4145 - DNA, 21 bp, Zea mays
ggttgtttgacttctgcgcag

SEQ ID NO: 4146 - DNA, 21 bp, Zea mays
tttgacactcggcaaagaagc

SEQ ID NO: 4147 - DNA, 21 bp, Zea mays
tgcttaagtgcgtcaccgaaa

SEQ ID NO: 4148 - DNA, 21 bp, Zea mays
ggggctcccaaactagcccta

SEQ ID NO: 4149 - DNA, 21 bp, Zea mays
atctgcatccatagacgtttt

SEQ ID NO: 4150 - DNA, 21 bp, Zea mays
atgggcactcggcaaagactg

SEQ ID NO: 4151 - DNA, 21 bp, Zea mays
tggtggcactcggcaaagaaa

SEQ ID NO: 4152 - DNA, 21 bp, Zea mays
gatagctcgtttagctcgcga

SEQ ID NO: 4153 - DNA, 21 bp, Zea mays
accatggattctcaggcgcca

SEQ ID NO: 4154 - DNA, 21 bp, Zea mays
ttttctggtcaccaaatcagc

SEQ ID NO: 4155 - DNA, 21 bp, Zea mays
ggcgtctttgccgagtgtcac

SEQ ID NO: 4156 - DNA, 21 bp, Zea mays
caccatgcgccgtcgcaatgg

SEQ ID NO: 4157 - DNA, 21 bp, Zea mays
gcactcggcaaagtctttgcc

SEQ ID NO: 4158 - DNA, 21 bp, Zea mays
gggcacggcccgtttagcacg

SEQ ID NO: 4159 - DNA, 21 bp, Zea mays
ccatttagctgctccgttgga

SEQ ID NO: 4160 - DNA, 21 bp, Zea mays
agccacacatcacaagcggtt

SEQ ID NO: 4161 - DNA, 21 bp, Zea mays
ctcacatccggtcgttttggt

SEQ ID NO: 4162 - DNA, 21 bp, Zea mays
aactagctagactacaacgga

SEQ ID NO: 4163 - DNA, 21 bp, Zea mays
tagcctttcgccgagcacttg

SEQ ID NO: 4164 - DNA, 21 bp, Zea mays
ggcctccgcctgagcggggag

SEQ ID NO: 4165 - DNA, 21 bp, Zea mays
gttctcgttgcaacgcacggg

SEQ ID NO: 4166 - DNA, 21 bp, Zea mays
gctggaatgggcttggcccag

SEQ ID NO: 4167 - DNA, 21 bp, Zea mays
cataatactgatggttgcaat

SEQ ID NO: 4168 - DNA, 21 bp, Zea mays
ttaactccgtagcaacgcacg

SEQ ID NO: 4169 - DNA, 21 bp, Zea mays
ttaccactgaactacgctcgc

SEQ ID NO: 4170 - DNA, 21 bp, Zea mays
ccgtctcccttcccataagca

SEQ ID NO: 4171 - DNA, 21 bp, Zea mays
cggttcttcggttcggttcgg

SEQ ID NO: 4172 - DNA, 21 bp, Zea mays
tatgttctgtgtttggtaatc

SEQ ID NO: 4173 - DNA, 21 bp, Zea mays
tccacaaccaaacgcaccctt

SEQ ID NO: 4174 - DNA, 21 bp, Zea mays
gagccgtcggacttaattcag

SEQ ID NO: 4175 - DNA, 21 bp, Zea mays
gcgtcctccttcctctcgtcg

SEQ ID NO: 4176 - DNA, 21 bp, Zea mays
acacagtcatcccgagggagt

SEQ ID NO: 4177 - DNA, 21 bp, Zea mays
accgtggcactcggcaaagaa

SEQ ID NO: 4178 - DNA, 21 bp, Zea mays
ggtcgcctctaggaagttagc

SEQ ID NO: 4179 - DNA, 21 bp, Zea mays
tcgtggcggcccggcgcggcg

SEQ ID NO: 4180 - DNA, 21 bp, Zea mays
cagctcggcgccataggctgt

SEQ ID NO: 4181 - DNA, 21 bp, Zea mays
catagctgtctgaggtctttg

SEQ ID NO: 4182 - DNA, 21 bp, Zea mays
gaccgggcggcccgaatgtac

SEQ ID NO: 4183 - DNA, 21 bp, Zea mays
ttttctttgccgagtgctttt

SEQ ID NO: 4184 - DNA, 21 bp, Zea mays
agtcatcaggcacacaccacc

SEQ ID NO: 4185 - DNA, 21 bp, Zea mays
acagtgtcttcccgtcactgg

SEQ ID NO: 4186 - DNA, 21 bp, Zea mays
agagtgacttggccgtccatc

SEQ ID NO: 4187 - DNA, 21 bp, Zea mays
tggagccttctttgtcgagtg

SEQ ID NO: 4188 - DNA, 21 bp, Zea mays
tgctccacgtctgttagcgca

SEQ ID NO: 4189 - DNA, 21 bp, Zea mays
ggccaaagccgtcggacataa

SEQ ID NO: 4190 - DNA, 21 bp, Zea mays
gactgccgtcgtgcagtggcc

SEQ ID NO: 4191 - DNA, 21 bp, Zea mays
gtggctttgccgagtgctttt

SEQ ID NO: 4192 - DNA, 21 bp, Zea mays
accctaaagggttctgtaccc

SEQ ID NO: 4193 - DNA, 21 bp, Zea mays
gcgtcctctaaacggtcctct

SEQ ID NO: 4194 - DNA, 21 bp, Zea mays
gcatccgtctccgcaaaacac

SEQ ID NO: 4195 - DNA, 21 bp, Zea mays
caagagcacaagcgggatcct

SEQ ID NO: 4196 - DNA, 21 bp, Zea mays
agcaaagtctttgccgagtgt

SEQ ID NO: 4197 - DNA, 21 bp, Zea mays
aaactctttgccgagtgtttt

SEQ ID NO: 4198 - DNA, 21 bp, Zea mays
ggctgtttgacttctgcgcag

SEQ ID NO: 4199 - DNA, 21 bp, Zea mays
ttcggcgccatagcctatggc

SEQ ID NO: 4200 - DNA, 21 bp, Zea mays
aacaaaacaccccgctccaac

SEQ ID NO: 4201 - DNA, 21 bp, Zea mays
agctcggcgccataggctatg

SEQ ID NO: 4202 - DNA, 21 bp, Zea mays
aagctcggcgccatagcctat

SEQ ID NO: 4203 - DNA, 21 bp, Zea mays
agatcttggcgccgagctagg

SEQ ID NO: 4204 - DNA, 21 bp, Zea mays
tgtcacactcggcaaagcctt

SEQ ID NO: 4205 - DNA, 21 bp, Zea mays
ccatcccgctctcacagtcac

SEQ ID NO: 4206 - DNA, 21 bp, Zea mays
gagggcagaaacgaatgtggt

SEQ ID NO: 4207 - DNA, 21 bp, Zea mays
gaatacactcggcaaagcctt

SEQ ID NO: 4208 - DNA, 21 bp, Zea mays
ttgctcggcgtcatagcctat

SEQ ID NO: 4209 - DNA, 21 bp, Zea mays
aatccccattgccatctctac

SEQ ID NO: 4210 - DNA, 21 bp, Zea mays
tgccagcaccagcccgctaat

SEQ ID NO: 4211 - DNA, 21 bp, Zea mays
gccgatgcgggtcgcagcgat

SEQ ID NO: 4212 - DNA, 21 bp, Zea mays
tgtgctttctttgtcgagtgc

SEQ ID NO: 4213 - DNA, 21 bp, Zea mays
tagagcctggctcacagcaac

SEQ ID NO: 4214 - DNA, 21 bp, Zea mays
cggatggcttctacctgcaag

SEQ ID NO: 4215 - DNA, 21 bp, Zea mays
taagacgggtcccgtcggaag

SEQ ID NO: 4216 - DNA, 21 bp, Zea mays
agggcgcagccaatattcagc

SEQ ID NO: 4217 - DNA, 21 bp, Zea mays
tggtcagtctagccgtcggac

SEQ ID NO: 4218 - DNA, 21 bp, Zea mays
ggtgagctcgctcgactcgtg

SEQ ID NO: 4219 - DNA, 21 bp, Zea mays
ccgccggacgggcacggccca

SEQ ID NO: 4220 - DNA, 21 bp, Zea mays
cgtggctaactgtgtcacact

SEQ ID NO: 4221 - DNA, 21 bp, Zea mays
acaaagtgcgcacaaaagact

SEQ ID NO: 4222 - DNA, 21 bp, Zea mays
gcacgacgttcttggctcttg

SEQ ID NO: 4223 - DNA, 21 bp, Zea mays
ggacttagcacaacaagtgcg

SEQ ID NO: 4224 - DNA, 21 bp, Zea mays
ctctccggttttgtggctctc

SEQ ID NO: 4225 - DNA, 21 bp, Zea mays
tcgcgctgctagcttcgtctt

SEQ ID NO: 4226 - DNA, 21 bp, Zea mays
aagtttctttgccgagtgcca

SEQ ID NO: 4227 - DNA, 21 bp, Zea mays
acaccccgtcttcggatctgc

SEQ ID NO: 4228 - DNA, 21 bp, Zea mays
cgtttgcatagaaggaccgct

SEQ ID NO: 4229 - DNA, 21 bp, Zea mays
tgtcttcacctgattcttggg

SEQ ID NO: 4230 - DNA, 21 bp, Zea mays
tggaacgtcgacaaccttcgc

SEQ ID NO: 4231 - DNA, 21 bp, Zea mays
gatgggggggggggggggggg

SEQ ID NO: 4232 - DNA, 21 bp, Zea mays
ctgctcccatgctccagtctt

SEQ ID NO: 4233 - DNA, 21 bp, Zea mays
taaactcacacccaaacccgc

SEQ ID NO: 4234 - DNA, 21 bp, Zea mays
cgccacaaaccaaacaggccc

SEQ ID NO: 4235 - DNA, 21 bp, Zea mays
gaacggttgcgggacgagtga

SEQ ID NO: 4236 - DNA, 21 bp, Zea mays
ccgacctatagccgcagcggt

SEQ ID NO: 4237 - DNA, 21 bp, Zea mays
gactcatagcacagtgtttag

SEQ ID NO: 4238 - DNA, 21 bp, Zea mays
agctcggcaccaagatctgtg

SEQ ID NO: 4239 - DNA, 21 bp, Zea mays
gcccggcgccaagatctatgg

SEQ ID NO: 4240 - DNA, 21 bp, Zea mays
cagctggcactcggcaaagaa

SEQ ID NO: 4241 - DNA, 21 bp, Zea mays
gcacgctggcactcggcaaag

SEQ ID NO: 4242 - DNA, 21 bp, Zea mays
gtgcgccgccggtcagagcag

SEQ ID NO: 4243 - DNA, 21 bp, Zea mays
cttccacgtgttcgatcgcgt

SEQ ID NO: 4244 - DNA, 21 bp, Zea mays
ccgagctcggcgccaagatct

SEQ ID NO: 4245 - DNA, 21 bp, Zea mays
tttgcagcccaataaaccagt

SEQ ID NO: 4246 - DNA, 21 bp, Zea mays
tcagcactatgggccgaggct

SEQ ID NO: 4247 - DNA, 21 bp, Zea mays
accacgatgtttacagccctc

SEQ ID NO: 4248 - DNA, 21 bp, Zea mays
cggaaaaaaagcacggtccag

SEQ ID NO: 4249 - DNA, 21 bp, Zea mays
ctgactccgtagcaacgcacg

SEQ ID NO: 4250 - DNA, 21 bp, Zea mays
tgctcggcgccatagactatg

SEQ ID NO: 4251 - DNA, 21 bp, Zea mays
tctaacgtgccgtgttagccc

SEQ ID NO: 4252 - DNA, 21 bp, Zea mays
tttttggcactcggcaaagaa

SEQ ID NO: 4253 - DNA, 21 bp, Zea mays
tagctcggcgccatagcctgt

SEQ ID NO: 4254 - DNA, 21 bp, Zea mays
cgccatcgctgcgacccgcat

SEQ ID NO: 4255 - DNA, 21 bp, Zea mays
gggtataagtgcggtcactgc

SEQ ID NO: 4256 - DNA, 21 bp, Zea mays
cagcagcctgctgccccacgt

SEQ ID NO: 4257 - DNA, 21 bp, Zea mays
tccgcttccaaacagggccta

SEQ ID NO: 4258 - DNA, 21 bp, Zea mays
atcgggcactcggcaaagaaa

SEQ ID NO: 4259 - DNA, 21 bp, Zea mays
cgctcgacaaaggctttgccg

SEQ ID NO: 4260 - DNA, 21 bp, Zea mays
cctagcacacgagccacaaaa

SEQ ID NO: 4261 - DNA, 21 bp, Zea mays
gacaaagtctttgccgagtgt

SEQ ID NO: 4262 - DNA, 21 bp, Zea mays
gcaaagtctttgccgagtgtc

SEQ ID NO: 4263 - DNA, 21 bp, Zea mays
cacggcattcggtgtcagctg

SEQ ID NO: 4264 - DNA, 21 bp, Zea mays
aggtatcaggcacacaccacc

SEQ ID NO: 4265 - DNA, 21 bp, Zea mays
tcatgcgcgaagtccacagcg

SEQ ID NO: 4266 - DNA, 21 bp, Zea mays
atgtttccgttgcaacgcacg

SEQ ID NO: 4267 - DNA, 21 bp, Zea mays
ggggtggtaatggatcgcgat

SEQ ID NO: 4268 - DNA, 21 bp, Zea mays
gcttattttcggcggcgtctg

SEQ ID NO: 4269 - DNA, 21 bp, Zea mays
agctattttcggcggcgtctg

SEQ ID NO: 4270 - DNA, 21 bp, Zea mays
ttgagtcactttgccgagtgt

SEQ ID NO: 4271 - DNA, 21 bp, Zea mays
atgctcggcgccataggctgt

SEQ ID NO: 4272 - DNA, 21 bp, Zea mays
agaagctgcctgtttggcagg

SEQ ID NO: 4273 - DNA, 21 bp, Zea mays
gcaggcgccgctgcagtcatt

SEQ ID NO: 4274 - DNA, 21 bp, Zea mays
ctttaccgagtgtcgcactcg

SEQ ID NO: 4275 - DNA, 21 bp, Zea mays
aagccacaacacaagtttgtc

SEQ ID NO: 4276 - DNA, 21 bp, Zea mays
gcagacactcggcaaagaagc

SEQ ID NO: 4277 - DNA, 21 bp, Zea mays
atcctaatccgtcgggtcgga

SEQ ID NO: 4278 - DNA, 21 bp, Zea mays
accctgcactcagtcgtgttt

SEQ ID NO: 4279 - DNA, 21 bp, Zea mays
cgtcagcagtagaggcgcgag

SEQ ID NO: 4280 - DNA, 21 bp, Zea mays
tgccagtcacagcgatgtacg

SEQ ID NO: 4281 - DNA, 21 bp, Zea mays
gccggccggcaacttctcact

SEQ ID NO: 4282 - DNA, 21 bp, Zea mays
ctgcgggtggggtctatcctc

SEQ ID NO: 4283 - DNA, 21 bp, Zea mays
ctctaaggaacccgtagactg

SEQ ID NO: 4284 - DNA, 21 bp, Zea mays
caaagcactcggcaaagactg

SEQ ID NO: 4285 - DNA, 21 bp, Zea mays
tgctttcttttgtcgagtgct

SEQ ID NO: 4286 - DNA, 21 bp, Zea mays
cagggagcgcgggttagattt

SEQ ID NO: 4287 - DNA, 21 bp, Zea mays
aaaaacactcggcaaagcctt

SEQ ID NO: 4288 - DNA, 21 bp, Zea mays
aagttctttgccgagtgtttt

SEQ ID NO: 4289 - DNA, 21 bp, Zea mays
ggcccgataaatgggtcggcc

SEQ ID NO: 4290 - DNA, 21 bp, Zea mays
tatgccgtcgcaacgcacggg

SEQ ID NO: 4291 - DNA, 21 bp, Zea mays
aaattagccgaaaccagagtc

SEQ ID NO: 4292 - DNA, 21 bp, Zea mays
gtccagatcgattaacggcag

SEQ ID NO: 4293 - DNA, 21 bp, Zea mays
tcgatctggaccgtccgtggc

SEQ ID NO: 4294 - DNA, 21 bp, Zea mays
acacaaacgaacaaggcctca

SEQ ID NO: 4295 - DNA, 21 bp, Zea mays
cgattaccaacgcagcctgat

SEQ ID NO: 4296 - DNA, 21 bp, Zea mays
aggcacgccgtctgcaggatg

SEQ ID NO: 4297 - DNA, 21 bp, Zea mays
tcgcactcggcaaagaaggct

SEQ ID NO: 4298 - DNA, 21 bp, Zea mays
gcaaagccctctttgccgagt

SEQ ID NO: 4299 - DNA, 21 bp, Zea mays
actggcactcggcaaagcttg

SEQ ID NO: 4300 - DNA, 21 bp, Zea mays
tgggcctcactcgtggcccgt

SEQ ID NO: 4301 - DNA, 21 bp, Zea mays
agaccgtcggacataagctta

SEQ ID NO: 4302 - DNA, 21 bp, Zea mays
tcggattgcacccggaatcgt

SEQ ID NO: 4303 - DNA, 21 bp, Zea mays
aggccgtcggacataagctta

SEQ ID NO: 4304 - DNA, 21 bp, Zea mays
acctctgtgtcgtgtctgctc

SEQ ID NO: 4305 - DNA, 21 bp, Zea mays
gggggcgagtccttgccctcc

SEQ ID NO: 4306 - DNA, 21 bp, Zea mays
ttctcgttgcaacgcacagac

SEQ ID NO: 4307 - DNA, 21 bp, Zea mays
gttagtcctaagccgacggat

SEQ ID NO: 4308 - DNA, 21 bp, Zea mays
ataaaaaaacactcggcaaag

SEQ ID NO: 4309 - DNA, 21 bp, Zea mays
ttagcactcggcaaaaagccg

SEQ ID NO: 4310 - DNA, 21 bp, Zea mays
accgggttggacagtcgagtg

SEQ ID NO: 4311 - DNA, 21 bp, Zea mays
ccatgctgctccagtgcacag

SEQ ID NO: 4312 - DNA, 21 bp, Zea mays
tagtacttactcctggcagct

SEQ ID NO: 4313 - DNA, 21 bp, Zea mays
gagggcactcggcaaagcttg

SEQ ID NO: 4314 - DNA, 21 bp, Zea mays
ggccttgtttagttgtgccgg

SEQ ID NO: 4315 - DNA, 21 bp, Zea mays
cggccgtcggacataagctta

SEQ ID NO: 4316 - DNA, 21 bp, Zea mays
agagcgcagccaatattcagc

SEQ ID NO: 4317 - DNA, 21 bp, Zea mays
actggtcactttgccgagtgt

SEQ ID NO: 4318 - DNA, 21 bp, Zea mays
cacttaggctgcgttcgtttg

SEQ ID NO: 4319 - DNA, 21 bp, Zea mays
ccgtcgtacgaagtcgtcgcc

SEQ ID NO: 4320 - DNA, 21 bp, Zea mays
ggtccagcactgacttcgaca

SEQ ID NO: 4321 - DNA, 21 bp, Zea mays
gatcgctggcactcggcaaag

SEQ ID NO: 4322 - DNA, 21 bp, Zea mays
cttgctgatttcctgctgaga

SEQ ID NO: 4323 - DNA, 21 bp, Zea mays
ctgggcctctaggaagttagc

SEQ ID NO: 4324 - DNA, 21 bp, Zea mays
gatgccgtcggacatagcgtt

SEQ ID NO: 4325 - DNA, 21 bp, Zea mays
aagattatgtccgacggctgt

SEQ ID NO: 4326 - DNA, 21 bp, Zea mays
gacactcggcaaagccgccgt

SEQ ID NO: 4327 - DNA, 21 bp, Zea mays
agggtgcactcggcaaagaaa

SEQ ID NO: 4328 - DNA, 21 bp, Zea mays
gcagcacgcctcagcttcgct

SEQ ID NO: 4329 - DNA, 21 bp, Zea mays
actggctcaaagcacggtccg

SEQ ID NO: 4330 - DNA, 21 bp, Zea mays
tgtacacgtgtcccgccagtc

SEQ ID NO: 4331 - DNA, 21 bp, Zea mays
ggcgaagtctttgccgagtgt

SEQ ID NO: 4332 - DNA, 21 bp, Zea mays
tggtggccggccggccggccg

SEQ ID NO: 4333 - DNA, 21 bp, Zea mays
tctgcgccagtcatggtgtcc

SEQ ID NO: 4334 - DNA, 21 bp, Zea mays
gcgcaaggttgagtcacagcg

SEQ ID NO: 4335 - DNA, 21 bp, Zea mays
attgacactcggcaaagaagc

SEQ ID NO: 4336 - DNA, 21 bp, Zea mays
cccgcccacgcgcccagctcc

SEQ ID NO: 4337 - DNA, 21 bp, Zea mays
ccatggcagatggcttcggat

SEQ ID NO: 4338 - DNA, 21 bp, Zea mays
ccaaactggcccagtatcttt

SEQ ID NO: 4339 - DNA, 21 bp, Zea mays
aagcaccagtttcaacggtcg

SEQ ID NO: 4340 - DNA, 21 bp, Zea mays
gagcttgttcggttagaccaa

SEQ ID NO: 4341 - DNA, 21 bp, Zea mays
gcaagtcattcaggcttacac

SEQ ID NO: 4342 - DNA, 21 bp, Zea mays
accgggcaggcaagccgcaag

SEQ ID NO: 4343 - DNA, 21 bp, Zea mays
ccctgacgcagcaccgttgga

SEQ ID NO: 4344 - DNA, 21 bp, Zea mays
cctagacgcaactagccgttg

SEQ ID NO: 4345 - DNA, 21 bp, Zea mays
cggtcctatcgggtcggatac

SEQ ID NO: 4346 - DNA, 21 bp, Zea mays
cggcttctttgccgagtgctt

SEQ ID NO: 4347 - DNA, 21 bp, Zea mays
gtgcccgtgcgttgcaacggt

SEQ ID NO: 4348 - DNA, 21 bp, Zea mays
gcctgccacagactcagccaa

SEQ ID NO: 4349 - DNA, 21 bp, Zea mays
ccatccctcgcctcccccaca

SEQ ID NO: 4350 - DNA, 21 bp, Zea mays
aagcagatactagatgtaagc

SEQ ID NO: 4351 - DNA, 21 bp, Zea mays
tggcactatgaggtcttcgac

SEQ ID NO: 4352 - DNA, 21 bp, Zea mays
ggttccgttgcaacgcacggg

SEQ ID NO: 4353 - DNA, 21 bp, Zea mays
gggcgtggacggaattcggtc

SEQ ID NO: 4354 - DNA, 21 bp, Zea mays
aggaccactaccgcagcatca

SEQ ID NO: 4355 - DNA, 21 bp, Zea mays
gaacctgtagccatcccaaac

SEQ ID NO: 4356 - DNA, 21 bp, Zea mays
acaaagtctttgccgagtgtc

SEQ ID NO: 4357 - DNA, 21 bp, Zea mays
acgcacaggcactcacctagt

SEQ ID NO: 4358 - DNA, 21 bp, Zea mays
gcgcctacaggtggggtccat

SEQ ID NO: 4359 - DNA, 21 bp, Zea mays
tacctcggcgccataggctgt

SEQ ID NO: 4360 - DNA, 21 bp, Zea mays
aaatcgtcggagtcgctcaac

SEQ ID NO: 4361 - DNA, 21 bp, Zea mays
ctggtgccctcagttttgctg

SEQ ID NO: 4362 - DNA, 21 bp, Zea mays
tgggtcttgttctgctggctg

SEQ ID NO: 4363 - DNA, 21 bp, Zea mays
tgacacaaacgaacaaggcct

SEQ ID NO: 4364 - DNA, 21 bp, Zea mays
gtacctcggcgccataggcta

SEQ ID NO: 4365 - DNA, 21 bp, Zea mays
aaacccgtcggttgtcagccg

SEQ ID NO: 4366 - DNA, 21 bp, Zea mays
caataactacggaactcctat

SEQ ID NO: 4367 - DNA, 21 bp, Zea mays
cccgtcgagcaactcagcaag

SEQ ID NO: 4368 - DNA, 21 bp, Zea mays
cctcatttttgtgaggggctg

SEQ ID NO: 4369 - DNA, 21 bp, Zea mays
cctgtagcgatttagagcgac

SEQ ID NO: 4370 - DNA, 21 bp, Zea mays
agctttctttgccgagtgcca

SEQ ID NO: 4371 - DNA, 21 bp, Zea mays
ctttgccgagtgccacgcaaa

SEQ ID NO: 4372 - DNA, 21 bp, Zea mays
agctgtgatgatggaagcatc

SEQ ID NO: 4373 - DNA, 21 bp, Zea mays
cctggtcaccaaatcagccca

SEQ ID NO: 4374 - DNA, 21 bp, Zea mays
catgtccatcaacggtcacat

SEQ ID NO: 4375 - DNA, 21 bp, Zea mays
cctacacctctcaagtcattt

SEQ ID NO: 4376 - DNA, 21 bp, Zea mays
aaacttctttgccgagtgcct

SEQ ID NO: 4377 - DNA, 21 bp, Zea mays
tcagacactcggcaaagacgt

SEQ ID NO: 4378 - DNA, 21 bp, Zea mays
gacgtctttgccgagtgtctg

SEQ ID NO: 4379 - DNA, 21 bp, Zea mays
gagtacgaccgggcgtggacg

SEQ ID NO: 4380 - DNA, 21 bp, Zea mays
ccgagagcaggactttgccga

SEQ ID NO: 4381 - DNA, 21 bp, Zea mays
acggctcccaaactagcccta

SEQ ID NO: 4382 - DNA, 21 bp, Zea mays
tgggtggcactcggcaaagaa

SEQ ID NO: 4383 - DNA, 21 bp, Zea mays
cggggacactcggcaaaggct

SEQ ID NO: 4384 - DNA, 21 bp, Zea mays
cagccgtcggacataagctta

SEQ ID NO: 4385 - DNA, 21 bp, Zea mays
atcgtggaatcttggtccgac

SEQ ID NO: 4386 - DNA, 21 bp, Zea mays
gcggcctgtgatgaccccaac

SEQ ID NO: 4387 - DNA, 21 bp, Zea mays
ggctggtcgtctattcttctg

SEQ ID NO: 4388 - DNA, 21 bp, Zea mays
tctccgttgcaacgcacagac

SEQ ID NO: 4389 - DNA, 21 bp, Zea mays
cacggtctccgtcgatgaggt

SEQ ID NO: 4390 - DNA, 21 bp, Zea mays
aatggtccgccgaaatccggc

SEQ ID NO: 4391 - DNA, 21 bp, Zea mays
agccccagcgagcatcatcgc

SEQ ID NO: 4392 - DNA, 21 bp, Zea mays
tcaagtcattcaggcttacac

SEQ ID NO: 4393 - DNA, 21 bp, Zea mays
gacgtgaccgccagagtctcc

SEQ ID NO: 4394 - DNA, 21 bp, Zea mays
tgccccacgtctgttagcgca

SEQ ID NO: 4395 - DNA, 21 bp, Zea mays
ccaaacactcggcaaagtctc

SEQ ID NO: 4396 - DNA, 21 bp, Zea mays
ggtgctaagcccgtcccacgc

SEQ ID NO: 4397 - DNA, 21 bp, Zea mays
ttcaaggaggcctgggacgcc

SEQ ID NO: 4398 - DNA, 21 bp, Zea mays
gtgtcacgatgcccgatcttc

SEQ ID NO: 4399 - DNA, 21 bp, Zea mays
tctcggcgccaagatctatgg

SEQ ID NO: 4400 - DNA, 21 bp, Zea mays
ctcgacgccatagatcttggc

SEQ ID NO: 4401 - DNA, 21 bp, Zea mays
tggtcccgcttctgccgcttg

SEQ ID NO: 4402 - DNA, 21 bp, Zea mays
gtgcaatagccactgcgcgag

SEQ ID NO: 4403 - DNA, 21 bp, Zea mays
gataaagtctttgccgagtgt

SEQ ID NO: 4404 - DNA, 21 bp, Zea mays
ggccacaccgcacacaaagtc

SEQ ID NO: 4405 - DNA, 21 bp, Zea mays
cagcgatccaaagtccaagca

SEQ ID NO: 4406 - DNA, 21 bp, Zea mays
aacctcggcgccataggctgt

SEQ ID NO: 4407 - DNA, 21 bp, Zea mays
taggctcccaaactagcccta

SEQ ID NO: 4408 - DNA, 21 bp, Zea mays
atctctggtcaccaaatcagc

SEQ ID NO: 4409 - DNA, 21 bp, Zea mays
gtaataagatttccgctgcaa

SEQ ID NO: 4410 - DNA, 21 bp, Zea mays
cgaagaacgtgggtacccacg

SEQ ID NO: 4411 - DNA, 21 bp, Zea mays
ggtacagagtcagggtcaagg

SEQ ID NO: 4412 - DNA, 21 bp, Zea mays
cagacggctgcaaactagaat

SEQ ID NO: 4413 - DNA, 21 bp, Zea mays
aacctacaggtgtggtcaatc

SEQ ID NO: 4414 - DNA, 21 bp, Zea mays
tcagacactcggcaaagaagc

SEQ ID NO: 4415 - DNA, 21 bp, Zea mays
gatttcggcgccataggctgt

SEQ ID NO: 4416 - DNA, 21 bp, Zea mays
ggcttctttgccgagtgtctg

SEQ ID NO: 4417 - DNA, 21 bp, Zea mays
atactctttgtcgagtgccag

SEQ ID NO: 4418 - DNA, 21 bp, Zea mays
gtagggcactcggcaaagaaa

SEQ ID NO: 4419 - DNA, 21 bp, Zea mays
gagctcgcccagcttcgtcgt

SEQ ID NO: 4420 - DNA, 21 bp, Zea mays
cctttctcctcttcggccttc

SEQ ID NO: 4421 - DNA, 21 bp, Zea mays
aagcaatttgtcgagcgcttg

SEQ ID NO: 4422 - DNA, 21 bp, Zea mays
tgaaccgcctgtgatgtaaaa

SEQ ID NO: 4423 - DNA, 21 bp, Zea mays
acgtttggtttctagggacta

SEQ ID NO: 4424 - DNA, 21 bp, Zea mays
gattgctggcactcggcaaag

SEQ ID NO: 4425 - DNA, 21 bp, Zea mays
cgctcgttggcttacgtcacg

SEQ ID NO: 4426 - DNA, 21 bp, Zea mays
gctaacttgccacactttgcc

SEQ ID NO: 4427 - DNA, 21 bp, Zea mays
acgcagtcatcccgagggagt

SEQ ID NO: 4428 - DNA, 21 bp, Zea mays
aatctctttgccgagtgtcac

SEQ ID NO: 4429 - DNA, 21 bp, Zea mays
ggcaaatgtggcaactgaggt

SEQ ID NO: 4430 - DNA, 21 bp, Zea mays
tggaggagtaggcaactcttc

SEQ ID NO: 4431 - DNA, 21 bp, Zea mays
cggtagaaacgaacaaggcct

SEQ ID NO: 4432 - DNA, 21 bp, Zea mays
gcggctttgccgagtgctttt

SEQ ID NO: 4433 - DNA, 21 bp, Zea mays
tccgtccactctgtcgccgtc

SEQ ID NO: 4434 - DNA, 21 bp, Zea mays
ccggacactcggcaaagaagc

SEQ ID NO: 4435 - DNA, 21 bp, Zea mays
ggagccgcatgcggagtgctg

SEQ ID NO: 4436 - DNA, 21 bp, Zea mays
agctctttgccgagtgctttt

SEQ ID NO: 4437 - DNA, 21 bp, Zea mays
ctgtagggcgctttgtcgagt

SEQ ID NO: 4438 - DNA, 21 bp, Zea mays
agaacctcccctcttagccac

SEQ ID NO: 4439 - DNA, 21 bp, Zea mays
gagagtctttgccgagagcca

SEQ ID NO: 4440 - DNA, 21 bp, Zea mays
gacgtctttgccgagagcctt

SEQ ID NO: 4441 - DNA, 21 bp, Zea mays
tctcggcaaagacgtctttgt

SEQ ID NO: 4442 - DNA, 21 bp, Zea mays
atagacgtctggacctggtcc

SEQ ID NO: 4443 - DNA, 21 bp, Zea mays
gaccgcctctaggaagttagc

SEQ ID NO: 4444 - DNA, 21 bp, Zea mays
ttacaaccttagccacgccga

SEQ ID NO: 4445 - DNA, 21 bp, Zea mays
aagtcaacgcacgcgatgatt

SEQ ID NO: 4446 - DNA, 21 bp, Zea mays
ggcgctttgccgagtgctttt

SEQ ID NO: 4447 - DNA, 21 bp, Zea mays
atccggctttgccgagtgccg

SEQ ID NO: 4448 - DNA, 21 bp, Zea mays
gcgtacttactcctggcagct

SEQ ID NO: 4449 - DNA, 21 bp, Zea mays
tccccaaccaaacacatccta

SEQ ID NO: 4450 - DNA, 21 bp, Zea mays
ccaaagtctttgccgagtgtc

SEQ ID NO: 4451 - DNA, 21 bp, Zea mays
taggaggcactcggcaaaaca

SEQ ID NO: 4452 - DNA, 21 bp, Zea mays
tggtgacactcggcaaaggct

SEQ ID NO: 4453 - DNA, 21 bp, Zea mays
ggcgcagtcacgactcgccta

SEQ ID NO: 4454 - DNA, 21 bp, Zea mays
aacttaggccttgttcgtttc

SEQ ID NO: 4455 - DNA, 21 bp, Zea mays
tagcgggttctttgccgagtg

SEQ ID NO: 4456 - DNA, 21 bp, Zea mays
atggctgtcagtatagccgtc

SEQ ID NO: 4457 - DNA, 21 bp, Zea mays
aatatggctgctcaagtgctt

SEQ ID NO: 4458 - DNA, 21 bp, Zea mays
cccagagtagtcgcccgaggc

SEQ ID NO: 4459 - DNA, 21 bp, Zea mays
gctgggacgacggtcgttgct

SEQ ID NO: 4460 - DNA, 21 bp, Zea mays
agtcctacgtggccgcatgcg

SEQ ID NO: 4461 - DNA, 21 bp, Zea mays
tctgaaagccgtcggacataa

SEQ ID NO: 4462 - DNA, 21 bp, Zea mays
tggcttaggccttgttcgttt

SEQ ID NO: 4463 - DNA, 21 bp, Zea mays
gccattcctgccgctgtaggt

SEQ ID NO: 4464 - DNA, 21 bp, Zea mays
tcatgcgccatagatcttggc

SEQ ID NO: 4465 - DNA, 21 bp, Zea mays
ccttactcatgcgcacccgag

SEQ ID NO: 4466 - DNA, 21 bp, Zea mays
gcaaaatgtggcaactgaggt

SEQ ID NO: 4467 - DNA, 21 bp, Zea mays
gtcacggcggcactcggcaaa

SEQ ID NO: 4468 - DNA, 21 bp, Zea mays
cgctaacttcctagaggcggc

SEQ ID NO: 4469 - DNA, 21 bp, Zea mays
ggccgcctctaggaagttagc

SEQ ID NO: 4470 - DNA, 21 bp, Zea mays
ataggttctttgccgagtgcg

SEQ ID NO: 4471 - DNA, 21 bp, Zea mays
ccagaacaaccatgacaccgc

SEQ ID NO: 4472 - DNA, 21 bp, Zea mays
cacaaaagctaccccgacgat

SEQ ID NO: 4473 - DNA, 21 bp, Zea mays
tccattatgtccgacggctgt

SEQ ID NO: 4474 - DNA, 21 bp, Zea mays
cagcagaaacgaacaaggcct

SEQ ID NO: 4475 - DNA, 21 bp, Zea mays
ttccaagtcctccgggctcag

SEQ ID NO: 4476 - DNA, 21 bp, Zea mays
gatgacactcggcaaagaagc

SEQ ID NO: 4477 - DNA, 21 bp, Zea mays
gcgccgagctaagggtccaaa

SEQ ID NO: 4478 - DNA, 21 bp, Zea mays
tgggacactcggcaaagaagc

SEQ ID NO: 4479 - DNA, 21 bp, Zea mays
accagctggcactcggcaaag

SEQ ID NO: 4480 - DNA, 21 bp, Zea mays
aagattatgtccgacggtctg

SEQ ID NO: 4481 - DNA, 21 bp, Zea mays
tcaggcgagtcgtgactgcgt

SEQ ID NO: 4482 - DNA, 21 bp, Zea mays
aatcatccaaaagactatcac

SEQ ID NO: 4483 - DNA, 21 bp, Zea mays
ccgctgtccgatgactgctcg

SEQ ID NO: 4484 - DNA, 21 bp, Zea mays
caacactcggcaaagaaggct

SEQ ID NO: 4485 - DNA, 21 bp, Zea mays
aggaatggattggttgaccaa

SEQ ID NO: 4486 - DNA, 21 bp, Zea mays
ggatcactcctgagctgagct

SEQ ID NO: 4487 - DNA, 21 bp, Zea mays
ttatcgttgccgagccacatc

SEQ ID NO: 4488 - DNA, 21 bp, Zea mays
cacgtggaccaatcagatcgc

SEQ ID NO: 4489 - DNA, 21 bp, Zea mays
cgtgccgtcgcaacgcacggg

SEQ ID NO: 4490 - DNA, 21 bp, Zea mays
tcacgctgctagcttcgtctt

SEQ ID NO: 4491 - DNA, 21 bp, Zea mays
ctaactttctacggcctcctc

SEQ ID NO: 4492 - DNA, 21 bp, Zea mays
cgggcggtctgcttcacacgg

SEQ ID NO: 4493 - DNA, 21 bp, Zea mays
caggaaagccgtcggacataa

SEQ ID NO: 4494 - DNA, 21 bp, Zea mays
tgggagcctggctctggagat

SEQ ID NO: 4495 - DNA, 21 bp, Zea mays
gatgcaaacgaacaaggcctt

SEQ ID NO: 4496 - DNA, 21 bp, Zea mays
tcccaccagtcatagacacgg

SEQ ID NO: 4497 - DNA, 21 bp, Zea mays
ctgaggcgtgacttaggcact

SEQ ID NO: 4498 - DNA, 21 bp, Zea mays
tgacactcggcaaagaaggct

SEQ ID NO: 4499 - DNA, 21 bp, Zea mays
gactgctcgtgatctgctgac

SEQ ID NO: 4500 - DNA, 21 bp, Zea mays
cacagtccagccgcacgtgga

SEQ ID NO: 4501 - DNA, 21 bp, Zea mays
acaaagtgtggcaactgaggt

SEQ ID NO: 4502 - DNA, 21 bp, Zea mays
tcacctctccaacaaagccat

SEQ ID NO: 4503 - DNA, 21 bp, Zea mays
ccgtgcgttgcgacggctcac

SEQ ID NO: 4504 - DNA, 21 bp, Zea mays
atccacttatatgggcttttg

SEQ ID NO: 4505 - DNA, 21 bp, Zea mays
ttcctaggggctacagtcagc

SEQ ID NO: 4506 - DNA, 21 bp, Zea mays
tggctctttgccgagtgtttt

SEQ ID NO: 4507 - DNA, 21 bp, Zea mays
atttcagcagcaggcaagcag

SEQ ID NO: 4508 - DNA, 21 bp, Zea mays
tctggcgacaacccactaatc

SEQ ID NO: 4509 - DNA, 21 bp, Zea mays
gttgataagcactggcgaagt

SEQ ID NO: 4510 - DNA, 21 bp, Zea mays
cgcgagcacattgtacggaag

SEQ ID NO: 4511 - DNA, 21 bp, Zea mays
aagccggcatgacgtgtctgt

SEQ ID NO: 4512 - DNA, 21 bp, Zea mays
ccatttaggccttgttcggtt

SEQ ID NO: 4513 - DNA, 21 bp, Zea mays
gccaccacctgtttttgacac

SEQ ID NO: 4514 - DNA, 21 bp, Zea mays
ttcagaacgtgggtacccacg

SEQ ID NO: 4515 - DNA, 21 bp, Zea mays
cccctcggcaaagtctttgcc

SEQ ID NO: 4516 - DNA, 21 bp, Zea mays
attggtttatggagtcactct

SEQ ID NO: 4517 - DNA, 21 bp, Zea mays
agactctttgccgagtgtctg

SEQ ID NO: 4518 - DNA, 21 bp, Zea mays
gacgttgctggagacagccta

SEQ ID NO: 4519 - DNA, 21 bp, Zea mays
cattcaaccaaacgcaccctt

SEQ ID NO: 4520 - DNA, 21 bp, Zea mays
ggtagctcggcgccaagatct

SEQ ID NO: 4521 - DNA, 21 bp, Zea mays
ctcagacgctcacaagttcat

SEQ ID NO: 4522 - DNA, 21 bp, Zea mays
tgacactcggcaaagtctttg

SEQ ID NO: 4523 - DNA, 21 bp, Zea mays
cctccacgtgttcgatcgcgt

SEQ ID NO: 4524 - DNA, 21 bp, Zea mays
gtttgtggctaactgtgtcac

SEQ ID NO: 4525 - DNA, 21 bp, Zea mays
agactctttgccgagtgtcac

SEQ ID NO: 4526 - DNA, 21 bp, Zea mays
ggccactcacaacagggtccc

SEQ ID NO: 4527 - DNA, 21 bp, Zea mays
caggttctttgccgagtgctt

SEQ ID NO: 4528 - DNA, 21 bp, Zea mays
catatcaagcgtttgactttc

SEQ ID NO: 4529 - DNA, 21 bp, Zea mays
ttttggggggggggggggggg

SEQ ID NO: 4530 - DNA, 21 bp, Zea mays
gcactgcactcagtcgtgttt

SEQ ID NO: 4531 - DNA, 21 bp, Zea mays
atcagcgtcatagatcttggc

SEQ ID NO: 4532 - DNA, 21 bp, Zea mays
gctagctcggcgccaagatct

SEQ ID NO: 4533 - DNA, 21 bp, Zea mays
ggcaaagttgagtcggacttg

SEQ ID NO: 4534 - DNA, 21 bp, Zea mays
cgaatttaggggacgctgctg

SEQ ID NO: 4535 - DNA, 21 bp, Zea mays
tctgtctgtctgtctctctct

SEQ ID NO: 4536 - DNA, 21 bp, Zea mays
ggtaggcgccaagatctatgg

SEQ ID NO: 4537 - DNA, 21 bp, Zea mays
ttaggcgccatagatcttggc

SEQ ID NO: 4538 - DNA, 21 bp, Zea mays
atcacacttcgccagaccgcc

SEQ ID NO: 4539 - DNA, 21 bp, Zea mays
gccgcactcggcaaagtcctg

SEQ ID NO: 4540 - DNA, 21 bp, Zea mays
cgcgggcactcggcaaagaaa

SEQ ID NO: 4541 - DNA, 21 bp, Zea mays
agcttggcgccacagatcttg

SEQ ID NO: 4542 - DNA, 21 bp, Zea mays
tggcaccaagatctgtggcac

SEQ ID NO: 4543 - DNA, 21 bp, Zea mays
cccgccgtatgaagtcgttgc

SEQ ID NO: 4544 - DNA, 21 bp, Zea mays
gcgcttatgtccgacggcccc

SEQ ID NO: 4545 - DNA, 21 bp, Zea mays
cactattaggcacggcactat

SEQ ID NO: 4546 - DNA, 21 bp, Zea mays
cgattaggtccttgtcgagca

SEQ ID NO: 4547 - DNA, 21 bp, Zea mays
gttatggattggtgggtcgga

SEQ ID NO: 4548 - DNA, 21 bp, Zea mays
gcatgtgggcccaataacttg

SEQ ID NO: 4549 - DNA, 21 bp, Zea mays
cgcttcccagacacatgccag

SEQ ID NO: 4550 - DNA, 21 bp, Zea mays
gtacgtgggcccaataacttg

SEQ ID NO: 4551 - DNA, 21 bp, Zea mays
cgtcttatgtccgacggcccc

SEQ ID NO: 4552 - DNA, 21 bp, Zea mays
tttttacgctccaccccgatt

SEQ ID NO: 4553 - DNA, 21 bp, Zea mays
tctaccgagatcctgattgga

SEQ ID NO: 4554 - DNA, 21 bp, Zea mays
gggatagccgccctacgtctg

SEQ ID NO: 4555 - DNA, 21 bp, Zea mays
tgacaggaaccagctcagctc

SEQ ID NO: 4556 - DNA, 21 bp, Zea mays
acatgtggacccaataacttg

SEQ ID NO: 4557 - DNA, 21 bp, Zea mays
agccttatgtccgacggcccc

SEQ ID NO: 4558 - DNA, 21 bp, Zea mays
agtccgtcgctgaggacgcct

SEQ ID NO: 4559 - DNA, 21 bp, Zea mays
tctcgttgcaacgcacgggca

SEQ ID NO: 4560 - DNA, 21 bp, Zea mays
gagagccgcactcggtaaagt

SEQ ID NO: 4561 - DNA, 21 bp, Zea mays
tcgtccaccaactgcatcttg

SEQ ID NO: 4562 - DNA, 21 bp, Zea mays
tgctcctggtcctcctcttgg

SEQ ID NO: 4563 - DNA, 21 bp, Zea mays
ttcatgggcccacatgtcagg

SEQ ID NO: 4564 - DNA, 21 bp, Zea mays
ggccggtctacggtggcagag

SEQ ID NO: 4565 - DNA, 21 bp, Zea mays
gactccccttaggccctgttc

SEQ ID NO: 4566 - DNA, 21 bp, Zea mays
gtccacgcagcaaaccgaggc

SEQ ID NO: 4567 - DNA, 21 bp, Zea mays
ctccatcccactcgaccgtcc

SEQ ID NO: 4568 - DNA, 21 bp, Zea mays
tggtcttcctcgtggacagct

SEQ ID NO: 4569 - DNA, 21 bp, Zea mays
tcggtccctttgccgagtgct

SEQ ID NO: 4570 - DNA, 21 bp, Zea mays
accgagaggcacccgcaccag

SEQ ID NO: 4571 - DNA, 21 bp, Zea mays
gtcacgatgcccgatcttcac

SEQ ID NO: 4572 - DNA, 21 bp, Zea mays
ttctttgccgagtgcccgata

SEQ ID NO: 4573 - DNA, 21 bp, Zea mays
agaagaccgtcggacataagc

SEQ ID NO: 4574 - DNA, 21 bp, Zea mays
gttccgccacagctggtatcg

SEQ ID NO: 4575 - DNA, 21 bp, Zea mays
atattctttgtcgagtgtcac

SEQ ID NO: 4576 - DNA, 21 bp, Zea mays
ctgtcctgtcattgcaaccaa

SEQ ID NO: 4577 - DNA, 21 bp, Zea mays
ctggccgccatcgctgcaacg

SEQ ID NO: 4578 - DNA, 21 bp, Zea mays
tacatcctcgtgccggagcaa

SEQ ID NO: 4579 - DNA, 21 bp, Zea mays
ccacagagacgtgatccaagc

SEQ ID NO: 4580 - DNA, 21 bp, Zea mays
gtaagggcttgtttggtttgt

SEQ ID NO: 4581 - DNA, 21 bp, Zea mays
cgcagccaggcccgtccgaga

SEQ ID NO: 4582 - DNA, 21 bp, Zea mays
tcgcctttgccgagtgctagc

SEQ ID NO: 4583 - DNA, 21 bp, Zea mays
gcgactttgccgagtgctagc

SEQ ID NO: 4584 - DNA, 21 bp, Zea mays
gcaacaacgtccaaatcccag

SEQ ID NO: 4585 - DNA, 21 bp, Zea mays
gcttcgccacccagcagcttc

SEQ ID NO: 4586 - DNA, 21 bp, Zea mays
tcctcaacgcgcccagcaacg

SEQ ID NO: 4587 - DNA, 21 bp, Zea mays
attggactcaggacggacgac

SEQ ID NO: 4588 - DNA, 21 bp, Zea mays
ctcagtgcccgtgcgttgcaa

SEQ ID NO: 4589 - DNA, 21 bp, Zea mays
agcctctttgccgagtgcctg

SEQ ID NO: 4590 - DNA, 21 bp, Zea mays
cccagcccgaaggtcgtttgc

SEQ ID NO: 4591 - DNA, 21 bp, Zea mays
tttcgggtcgtgctcgtgctg

SEQ ID NO: 4592 - DNA, 21 bp, Zea mays
agagcagccaggtgaccaacc

SEQ ID NO: 4593 - DNA, 21 bp, Zea mays
gatccggcactcggcaaagaa

SEQ ID NO: 4594 - DNA, 21 bp, Zea mays
catctggcactcggcaaagag

SEQ ID NO: 4595 - DNA, 21 bp, Zea mays
cgttgggctagcccgagcacg

SEQ ID NO: 4596 - DNA, 21 bp, Zea mays
gatgtgaggtgcgtgcctgca

SEQ ID NO: 4597 - DNA, 21 bp, Zea mays
catctcccgcagcggttcccc

SEQ ID NO: 4598 - DNA, 21 bp, Zea mays
gctgacccgcaaccaaacgca

SEQ ID NO: 4599 - DNA, 21 bp, Zea mays
gggcctgtgacgcacgagcac

SEQ ID NO: 4600 - DNA, 21 bp, Zea mays
agcggcgccacctcgagttcg

SEQ ID NO: 4601 - DNA, 21 bp, Zea mays
tcgagcagacgtcgggctcct

SEQ ID NO: 4602 - DNA, 21 bp, Zea mays
aacacggcactcggcaaagaa

SEQ ID NO: 4603 - DNA, 21 bp, Zea mays
actagccagttgctcgtgctt

SEQ ID NO: 4604 - DNA, 21 bp, Zea mays
gacctggagcactcctggaac

SEQ ID NO: 4605 - DNA, 21 bp, Zea mays
ctcgtgcactcggcaaagaaa

SEQ ID NO: 4606 - DNA, 21 bp, Zea mays
gtcctcgaccacttcaccgga

SEQ ID NO: 4607 - DNA, 21 bp, Zea mays
gaacctagccgtggaatcgcc

SEQ ID NO: 4608 - DNA, 21 bp, Zea mays
cagatctttgccgagtgcccg

SEQ ID NO: 4609 - DNA, 21 bp, Zea mays
agcagctcggcctcagcctcg

SEQ ID NO: 4610 - DNA, 21 bp, Zea mays
gaggggcctaagcgttttgct

SEQ ID NO: 4611 - DNA, 21 bp, Zea mays
aaagcttctttgccgagtgtc

SEQ ID NO: 4612 - DNA, 21 bp, Zea mays
ttttgtgcgcactttgtcctc

SEQ ID NO: 4613 - DNA, 21 bp, Zea mays
gcccgtgaaaccgcgagggtc

SEQ ID NO: 4614 - DNA, 21 bp, Zea mays
ccaccgccgccaaatcgctca

SEQ ID NO: 4615 - DNA, 21 bp, Zea mays
cgcctgaagccgcaccgctgc

SEQ ID NO: 4616 - DNA, 21 bp, Zea mays
catttggcactcggcaaagag

SEQ ID NO: 4617 - DNA, 21 bp, Zea mays
tgctgagcaacccagcgaggc

SEQ ID NO: 4618 - DNA, 21 bp, Zea mays
aacttctttgccgagtgcctg

SEQ ID NO: 4619 - DNA, 21 bp, Zea mays
gcctaccaccctgccaccggg

SEQ ID NO: 4620 - DNA, 21 bp, Zea mays
tcggtcaagcagcaggtggtg

SEQ ID NO: 4621 - DNA, 21 bp, Zea mays
gccgtcggacataaccgtatg

SEQ ID NO: 4622 - DNA, 21 bp, Zea mays
ccggtggcaagggtcagtaca

SEQ ID NO: 4623 - DNA, 21 bp, Zea mays
accaagaggcacccgcaccag

SEQ ID NO: 4624 - DNA, 21 bp, Zea mays
gctggcggctcagaccgtgga

SEQ ID NO: 4625 - DNA, 21 bp, Zea mays
gccggaatcgctcggtccacg

SEQ ID NO: 4626 - DNA, 21 bp, Zea mays
gacttggagcactcctggaac

SEQ ID NO: 4627 - DNA, 21 bp, Zea mays
gggcgcgtcgtcgtcgtcgtc

SEQ ID NO: 4628 - DNA, 21 bp, Zea mays
ttgcacctaatggttgtttgc

SEQ ID NO: 4629 - DNA, 21 bp, Zea mays
tgctcccgcacatgcagcgtt

SEQ ID NO: 4630 - DNA, 21 bp, Zea mays
ctcgcctccctctcgcccgcc

SEQ ID NO: 4631 - DNA, 21 bp, Zea mays
gtatcgcctcgctctcgcccg

SEQ ID NO: 4632 - DNA, 21 bp, Zea mays
tcctcctccgacgactcctca

SEQ ID NO: 4633 - DNA, 21 bp, Zea mays
gtagacgcggcccgatcttcc

SEQ ID NO: 4634 - DNA, 21 bp, Zea mays
aaatcgcgctcacccagaggg

SEQ ID NO: 4635 - DNA, 21 bp, Zea mays
tgggtgcggtcatccaatcag

SEQ ID NO: 4636 - DNA, 21 bp, Zea mays
ctcgcctccactctcgcccct

SEQ ID NO: 4637 - DNA, 21 bp, Zea mays
tatcttgcacgcggaccgagg

SEQ ID NO: 4638 - DNA, 21 bp, Zea mays
gcgtccgagcaaaagtcgcct

SEQ ID NO: 4639 - DNA, 21 bp, Zea mays
actaagggcctgtttggttca

SEQ ID NO: 4640 - DNA, 21 bp, Zea mays
aagcaaaagcctgcctagtcc

SEQ ID NO: 4641 - DNA, 21 bp, Zea mays
tagcgaagagtcggggcttgt

SEQ ID NO: 4642 - DNA, 21 bp, Zea mays
tttgccgtgtgtctcagacac

SEQ ID NO: 4643 - DNA, 21 bp, Zea mays
ctagagatgcgaccaatctgc

SEQ ID NO: 4644 - DNA, 21 bp, Zea mays
cacagcacagtgtttagggtg

SEQ ID NO: 4645 - DNA, 21 bp, Zea mays
tctcagccacccgccaatgat

SEQ ID NO: 4646 - DNA, 21 bp, Zea mays
gcccaaccagcaccccgctgg

SEQ ID NO: 4647 - DNA, 21 bp, Zea mays
gcaactcgcagcctgcgcgcc

SEQ ID NO: 4648 - DNA, 21 bp, Zea mays
gccgccccagccaaactcccc

SEQ ID NO: 4649 - DNA, 21 bp, Zea mays
cgacggcatcaacctatgtcc

SEQ ID NO: 4650 - DNA, 21 bp, Zea mays
atctgcagggtggccctggcg

SEQ ID NO: 4651 - DNA, 21 bp, Zea mays
aggcggcacatcgcttgtcag

SEQ ID NO: 4652 - DNA, 21 bp, Zea mays
ctggtcgccctgcactcagtc

SEQ ID NO: 4653 - DNA, 21 bp, Zea mays
ttcgctgcggctttaatccag

SEQ ID NO: 4654 - DNA, 21 bp, Zea mays
cgctgagcaacccagcgaggc

SEQ ID NO: 4655 - DNA, 21 bp, Zea mays
cgccgcgccctcctactcatc

SEQ ID NO: 4656 - DNA, 21 bp, Zea mays
ctttttgccgagtgtcaaaaa

SEQ ID NO: 4657 - DNA, 21 bp, Zea mays
ataggcgtcagcgcacatgag

SEQ ID NO: 4658 - DNA, 21 bp, Zea mays
cctggtcctctcctgcggaag

SEQ ID NO: 4659 - DNA, 21 bp, Zea mays
aggtgcacgcgctactttatg

SEQ ID NO: 4660 - DNA, 21 bp, Zea mays
tcgctggctcccatggtcaag

SEQ ID NO: 4661 - DNA, 21 bp, Zea mays
atcgagttgcaaccgggaacg

SEQ ID NO: 4662 - DNA, 21 bp, Zea mays
ttctttgccgagtgtcaaaaa

SEQ ID NO: 4663 - DNA, 21 bp, Zea mays
ccaccgcacgtcgaggtcggg

SEQ ID NO: 4664 - DNA, 21 bp, Zea mays
agccacaccaggaggacgacg

SEQ ID NO: 4665 - DNA, 21 bp, Zea mays
catccaacggcccacaaccct

SEQ ID NO: 4666 - DNA, 21 bp, Zea mays
cggctggcactcggcaaagag

SEQ ID NO: 4667 - DNA, 21 bp, Zea mays
tcatttacagccgctcgtcca

SEQ ID NO: 4668 - DNA, 21 bp, Zea mays
cataacttgtcacactttgcc

SEQ ID NO: 4669 - DNA, 21 bp, Zea mays
aggacgacggtgacgaccatg

SEQ ID NO: 4670 - DNA, 21 bp, Zea mays
gctcggcgccaagatctgtgg

SEQ ID NO: 4671 - DNA, 21 bp, Zea mays
tcacaaggtcctgcgaagcct

SEQ ID NO: 4672 - DNA, 21 bp, Zea mays
ccaccgccgcaagccgcgtcg

SEQ ID NO: 4673 - DNA, 21 bp, Zea mays
gacttctttgccgagtgcccg

SEQ ID NO: 4674 - DNA, 21 bp, Zea mays
gcggccctgcgtcgaggactc

SEQ ID NO: 4675 - DNA, 21 bp, Zea mays
gtgatctgggtcgcgttcggc

SEQ ID NO: 4676 - DNA, 21 bp, Zea mays
tgctcagtccacgatacgtgg

SEQ ID NO: 4677 - DNA, 21 bp, Zea mays
cgggctcgacagcgtccgcgg

SEQ ID NO: 4678 - DNA, 21 bp, Zea mays
actcaatcccacccaatccac

SEQ ID NO: 4679 - DNA, 21 bp, Zea mays
attacttctttgccgagtgtc

SEQ ID NO: 4680 - DNA, 21 bp, Zea mays
aaccctcccaacagcagtagg

SEQ ID NO: 4681 - DNA, 21 bp, Zea mays
ggggcttatcggcggcagtag

SEQ ID NO: 4682 - DNA, 21 bp, Zea mays
gaccgcgtcttcgccctacag

SEQ ID NO: 4683 - DNA, 21 bp, Zea mays
tgactcaggcgctctggctgg

SEQ ID NO: 4684 - DNA, 21 bp, Zea mays
gtggaactcagggtggacagc

SEQ ID NO: 4685 - DNA, 21 bp, Zea mays
gacatcgctcgctcgaacatc

SEQ ID NO: 4686 - DNA, 21 bp, Zea mays
cccagcaaggcactctatacc

SEQ ID NO: 4687 - DNA, 21 bp, Zea mays
gacacaaacgaacaaggcctg

SEQ ID NO: 4688 - DNA, 21 bp, Zea mays
tcatccgagcaaaagtcgcct

SEQ ID NO: 4689 - DNA, 21 bp, Zea mays
cttggcctaccaccctgccac

SEQ ID NO: 4690 - DNA, 21 bp, Zea mays
cctaccgcctccgggattgga

SEQ ID NO: 4691 - DNA, 21 bp, Zea mays
agtctcacccttcgcttcacc

SEQ ID NO: 4692 - DNA, 21 bp, Zea mays
ctcggcgccgtagatcttggc

SEQ ID NO: 4693 - DNA, 21 bp, Zea mays
gtcgaactggcagtcgccaag

SEQ ID NO: 4694 - DNA, 21 bp, Zea mays
tggtcgtgccgtgccaatttg

SEQ ID NO: 4695 - DNA, 21 bp, Zea mays
tccccgcgaacagttccgtca

SEQ ID NO: 4696 - DNA, 21 bp, Zea mays
tgtctatcacaggcggttctt

SEQ ID NO: 4697 - DNA, 21 bp, Zea mays
gaaggccgagcccaccggcac

SEQ ID NO: 4698 - DNA, 21 bp, Zea mays
ctcggcgccaagatctatggc

SEQ ID NO: 4699 - DNA, 21 bp, Zea mays
accacatccgacgacgacgcc

SEQ ID NO: 4700 - DNA, 21 bp, Zea mays
ttcggttcggttcctcggttc

SEQ ID NO: 4701 - DNA, 21 bp, Zea mays
gatcgggtctccgcctgagcg

SEQ ID NO: 4702 - DNA, 21 bp, Zea mays
ttcgggccgccggagcgtaat

SEQ ID NO: 4703 - DNA, 21 bp, Zea mays
caccttagggcttgttcggtt

SEQ ID NO: 4704 - DNA, 21 bp, Zea mays
ggaatggaacggctccgttct

SEQ ID NO: 4705 - DNA, 21 bp, Zea mays
gtgtagtgctaggcgtagaag

SEQ ID NO: 4706 - DNA, 21 bp, Zea mays
agccggtctacggtggcagag

SEQ ID NO: 4707 - DNA, 21 bp, Zea mays
gttgcaacgcacgggcactca

SEQ ID NO: 4708 - DNA, 21 bp, Zea mays
cttctccccgtagcctggctg

SEQ ID NO: 4709 - DNA, 21 bp, Zea mays
gctgtcttaatcgaccaacac

SEQ ID NO: 4710 - DNA, 21 bp, Zea mays
gtcctggcactcggcaaagag

SEQ ID NO: 4711 - DNA, 21 bp, Zea mays
ggccggcggcgcaccgaaggg

SEQ ID NO: 4712 - DNA, 21 bp, Zea mays
ccgcccgttggcttacgtcac

SEQ ID NO: 4713 - DNA, 21 bp, Zea mays
ctatccgaaccgcctgtgatg

SEQ ID NO: 4714 - DNA, 21 bp, Zea mays
tgactatcacaggcggttctt

SEQ ID NO: 4715 - DNA, 21 bp, Zea mays
gaccccaccggcccagagcct

SEQ ID NO: 4716 - DNA, 21 bp, Zea mays
gcaaatcacgccgccgtcctc

SEQ ID NO: 4717 - DNA, 21 bp, Zea mays
aaaaccgtcggacataaggaa

SEQ ID NO: 4718 - DNA, 21 bp, Zea mays
tccttctttgccgagtgcccg

SEQ ID NO: 4719 - DNA, 21 bp, Zea mays
tcgcctgtccaccctgctgac

SEQ ID NO: 4720 - DNA, 21 bp, Zea mays
tgagccgtcgcaacgcacggg

SEQ ID NO: 4721 - DNA, 21 bp, Zea mays
agagcttctttgccgagtgtc

SEQ ID NO: 4722 - DNA, 21 bp, Zea mays
agaaacccgcagtccaacagt

SEQ ID NO: 4723 - DNA, 21 bp, Zea mays
tcacactcggcaaagacttcg

SEQ ID NO: 4724 - DNA, 21 bp, Zea mays
ccgtgacactcggcaaaggct

SEQ ID NO: 4725 - DNA, 21 bp, Zea mays
aggcgcacgcgctactttatg

SEQ ID NO: 4726 - DNA, 21 bp, Zea mays
tctagtcaccaaatcagccct

SEQ ID NO: 4727 - DNA, 21 bp, Zea mays
atacttactcctggcagctct

SEQ ID NO: 4728 - DNA, 21 bp, Zea mays
taatccctcgcctacgcctcc

SEQ ID NO: 4729 - DNA, 21 bp, Zea mays
acgccgaggtaacacatagtg

SEQ ID NO: 4730 - DNA, 21 bp, Zea mays
cccaatccgacggaaacgaac

SEQ ID NO: 4731 - DNA, 21 bp, Zea mays
ggcgaactgtacatcggcaac

SEQ ID NO: 4732 - DNA, 21 bp, Zea mays
acgaccgtggactggcttctc

SEQ ID NO: 4733 - DNA, 21 bp, Zea mays
tactcggcgccataggctgtg

SEQ ID NO: 4734 - DNA, 21 bp, Zea mays
cggggctttgccgagtgcttt

SEQ ID NO: 4735 - DNA, 21 bp, Zea mays
gcgaccgtggactggcttctc

SEQ ID NO: 4736 - DNA, 21 bp, Zea mays
ctagtcgccctgcactcagtc

SEQ ID NO: 4737 - DNA, 21 bp, Zea mays
atgggtgcccgtgcgttgcaa

SEQ ID NO: 4738 - DNA, 21 bp, Zea mays
taggtgccgtttggttcgcga

SEQ ID NO: 4739 - DNA, 21 bp, Zea mays
cggttctttgccgagtgctcg

SEQ ID NO: 4740 - DNA, 21 bp, Zea mays
ttgattccgtagcaacgcacg

SEQ ID NO: 4741 - DNA, 21 bp, Zea mays
gtcaggccaacgtcgcacagg

SEQ ID NO: 4742 - DNA, 21 bp, Zea mays
tccatctttgccgagtgcccg

SEQ ID NO: 4743 - DNA, 21 bp, Zea mays
ccccgcatccaccgcaccacg

SEQ ID NO: 4744 - DNA, 21 bp, Zea mays
tacctgcgggtgggacctatc

SEQ ID NO: 4745 - DNA, 21 bp, Zea mays
ccccagaaaccaaacaccccc

SEQ ID NO: 4746 - DNA, 21 bp, Zea mays
acctcagcgccatagcctatg

SEQ ID NO: 4747 - DNA, 21 bp, Zea mays
ccaaatccatagactgtcgac

SEQ ID NO: 4748 - DNA, 21 bp, Zea mays
taatacatcacaggcggttcg

SEQ ID NO: 4749 - DNA, 21 bp, Zea mays
cgcatggcccaggcacgacac

SEQ ID NO: 4750 - DNA, 21 bp, Zea mays
cagcgccgccgtgagacatct

SEQ ID NO: 4751 - DNA, 21 bp, Zea mays
tgctgatcagccgtatcgcgg

SEQ ID NO: 4752 - DNA, 21 bp, Zea mays
cacgaggcagccgaagacccg

SEQ ID NO: 4753 - DNA, 21 bp, Zea mays
tatgcagtcttgtgcggagag

SEQ ID NO: 4754 - DNA, 21 bp, Zea mays
atcacgatgcccgatcttcac

SEQ ID NO: 4755 - DNA, 21 bp, Zea mays
aaattctttgccgagtgcccg

SEQ ID NO: 4756 - DNA, 21 bp, Zea mays
cctcggcgccacaggctatgg

SEQ ID NO: 4757 - DNA, 21 bp, Zea mays
ctagatttggcgtccgcatat

SEQ ID NO: 4758 - DNA, 21 bp, Zea mays
aatgttaagttcgacggtacc

SEQ ID NO: 4759 - DNA, 21 bp, Zea mays
tatgggccttacgtcaggctc

SEQ ID NO: 4760 - DNA, 21 bp, Zea mays
tgtcggcgtttcgaccccggg

SEQ ID NO: 4761 - DNA, 21 bp, Zea mays
tggatagggccaagaacgagg

SEQ ID NO: 4762 - DNA, 21 bp, Zea mays
gtcgcaaacagaagccgcagg

SEQ ID NO: 4763 - DNA, 21 bp, Zea mays
ttgtcgtgtcgtgccggcact

SEQ ID NO: 4764 - DNA, 21 bp, Zea mays
ggcgctcaatccactggaacc

SEQ ID NO: 4765 - DNA, 21 bp, Zea mays
tctaacttgtcacactttgcc

SEQ ID NO: 4766 - DNA, 21 bp, Zea mays
ttgagtgcccgtgcgttgcaa

SEQ ID NO: 4767 - DNA, 21 bp, Zea mays
gtgatctggcactcggcaaag

SEQ ID NO: 4768 - DNA, 21 bp, Zea mays
gtaggactgcttccagaggtc

SEQ ID NO: 4769 - DNA, 21 bp, Zea mays
atcgtacttttccggcaggtg

SEQ ID NO: 4770 - DNA, 21 bp, Zea mays
cgccacacgtcacaatgccag

SEQ ID NO: 4771 - DNA, 21 bp, Zea mays
tatgtcctcgtgccggagcaa

SEQ ID NO: 4772 - DNA, 21 bp, Zea mays
tttctccacagcctggctcgc

SEQ ID NO: 4773 - DNA, 21 bp, Zea mays
gtcgcatgtgctgtcacgttc

SEQ ID NO: 4774 - DNA, 21 bp, Zea mays
gatcctggcgctggacccagc

SEQ ID NO: 4775 - DNA, 21 bp, Zea mays
gctgtctgaggtctttgagac

SEQ ID NO: 4776 - DNA, 21 bp, Zea mays
tttagctcgcgagctggctcg

SEQ ID NO: 4777 - DNA, 21 bp, Zea mays
cactgtaacgcacggacactc

SEQ ID NO: 4778 - DNA, 21 bp, Zea mays
cgacgcctccctcagccggcg

SEQ ID NO: 4779 - DNA, 21 bp, Zea mays
cctgctggcttatgtcacggg

SEQ ID NO: 4780 - DNA, 21 bp, Zea mays
tgcctgaccggccgagcgcgg

SEQ ID NO: 4781 - DNA, 21 bp, Zea mays
cgtgcgcccgcaacaagtggg

SEQ ID NO: 4782 - DNA, 21 bp, Zea mays
cccgagctccgggagtcttcg

SEQ ID NO: 4783 - DNA, 21 bp, Zea mays
acttgtcaccaaatcagccct

SEQ ID NO: 4784 - DNA, 21 bp, Zea mays
tcggcgccatagcctatggcg

SEQ ID NO: 4785 - DNA, 21 bp, Zea mays
atcttctttgccgagtgttac

SEQ ID NO: 4786 - DNA, 21 bp, Zea mays
ttggtgttaccacggcttcac

SEQ ID NO: 4787 - DNA, 21 bp, Zea mays
gaagtctttgccgagtgtgac

SEQ ID NO: 4788 - DNA, 21 bp, Zea mays
tgggtgtccgtgcgttgcaac

SEQ ID NO: 4789 - DNA, 21 bp, Zea mays
atgaggggttttttgggctct

SEQ ID NO: 4790 - DNA, 21 bp, Zea mays
agggagacactcggcaaagag

SEQ ID NO: 4791 - DNA, 21 bp, Zea mays
gccttctttgccgagtgcccg

SEQ ID NO: 4792 - DNA, 21 bp, Zea mays
gattcctttgccgagtgccag

SEQ ID NO: 4793 - DNA, 21 bp, Zea mays
tgcgtggcactcggcaaagaa

SEQ ID NO: 4794 - DNA, 21 bp, Zea mays
tcctgacactcggcaaagcac

SEQ ID NO: 4795 - DNA, 21 bp, Zea mays
cagcactcggcaaagatggct

SEQ ID NO: 4796 - DNA, 21 bp, Zea mays
actacgcctcgcccgagccca

SEQ ID NO: 4797 - DNA, 21 bp, Zea mays
cgactcaggcgctctggctgg

SEQ ID NO: 4798 - DNA, 21 bp, Zea mays
gggttggctcggggagactct

SEQ ID NO: 4799 - DNA, 21 bp, Zea mays
cttaagggcctgtttggttca

SEQ ID NO: 4800 - DNA, 21 bp, Zea mays
ggtgtttggtttgcccctgct

SEQ ID NO: 4801 - DNA, 21 bp, Zea mays
ttgttcggttgctcaggaacg

SEQ ID NO: 4802 - DNA, 21 bp, Zea mays
cattgggtctccgcctgagcg

SEQ ID NO: 4803 - DNA, 21 bp, Zea mays
taaggcctgtttggtttgtgg

SEQ ID NO: 4804 - DNA, 21 bp, Zea mays
gagacaaacccatacccgcga

SEQ ID NO: 4805 - DNA, 21 bp, Zea mays
ctcgcaacatccgccgactcc

SEQ ID NO: 4806 - DNA, 21 bp, Zea mays
atgtgtggtaatggatcacga

SEQ ID NO: 4807 - DNA, 21 bp, Zea mays
cgttcgtggatggagcgattc

SEQ ID NO: 4808 - DNA, 21 bp, Zea mays
cgttccctcctcctggtggtg

SEQ ID NO: 4809 - DNA, 21 bp, Zea mays
ggggcttctttgccgagtgtc

SEQ ID NO: 4810 - DNA, 21 bp, Zea mays
gcgatctggcactcggcaaag

SEQ ID NO: 4811 - DNA, 21 bp, Zea mays
tgtatgcccgtgcgttgctac

SEQ ID NO: 4812 - DNA, 21 bp, Zea mays
ccacagtcgcgtgctgacgcg

SEQ ID NO: 4813 - DNA, 21 bp, Zea mays
cccagtcaccaaatcagccct

SEQ ID NO: 4814 - DNA, 21 bp, Zea mays
gcataggttctttgccgagtg

SEQ ID NO: 4815 - DNA, 21 bp, Zea mays
agcaactgcgcggacctgcca

SEQ ID NO: 4816 - DNA, 21 bp, Zea mays
tattagagcaactccaatagt

SEQ ID NO: 4817 - DNA, 21 bp, Zea mays
ccgtctgtgatgtaaaaagcc

SEQ ID NO: 4818 - DNA, 21 bp, Zea mays
gccccgactcatcctactttg

SEQ ID NO: 4819 - DNA, 21 bp, Zea mays
gtaccgccggtccagggattg

SEQ ID NO: 4820 - DNA, 21 bp, Zea mays
gtgcagccggactagcacaac

SEQ ID NO: 4821 - DNA, 21 bp, Zea mays
gtggcagccctgtagtcagcg

SEQ ID NO: 4822 - DNA, 21 bp, Zea mays
accctcgaccacttcaccgga

SEQ ID NO: 4823 - DNA, 21 bp, Zea mays
gctacgcagcacgacgacttc

SEQ ID NO: 4824 - DNA, 21 bp, Zea mays
atctggggctacctcctgagc

SEQ ID NO: 4825 - DNA, 21 bp, Zea mays
gatccggcatgagctgctcct

SEQ ID NO: 4826 - DNA, 21 bp, Zea mays
atggtggcccaggcacgacac

SEQ ID NO: 4827 - DNA, 21 bp, Zea mays
tgccccacatgtcatagacac

SEQ ID NO: 4828 - DNA, 21 bp, Zea mays
gctcgattgcatgcttgcacc

SEQ ID NO: 4829 - DNA, 21 bp, Zea mays
ccgcacatcgccgtgaccgtc

SEQ ID NO: 4830 - DNA, 21 bp, Zea mays
atgccgaagctccctggattg

SEQ ID NO: 4831 - DNA, 21 bp, Zea mays
gagggcatctccaacaacgga

SEQ ID NO: 4832 - DNA, 21 bp, Zea mays
tggaagacactcggcaaagag

SEQ ID NO: 4833 - DNA, 21 bp, Zea mays
ccactccagtgagccgagggc

SEQ ID NO: 4834 - DNA, 21 bp, Zea mays
gcccagcgcataactctggcc

SEQ ID NO: 4835 - DNA, 21 bp, Zea mays
aggcagactccggtcgagacg

SEQ ID NO: 4836 - DNA, 21 bp, Zea mays
aaacatgttcggttacaccaa

SEQ ID NO: 4837 - DNA, 21 bp, Zea mays
gtacttactcctggcagctct

SEQ ID NO: 4838 - DNA, 21 bp, Zea mays
gccgatcaaccatatcgcgga

SEQ ID NO: 4839 - DNA, 21 bp, Zea mays
tctgcaggtatgctcttcccg

SEQ ID NO: 4840 - DNA, 21 bp, Zea mays
ggagtgtcgcacgcgagggtg

SEQ ID NO: 4841 - DNA, 21 bp, Zea mays
ccgaggccttacgtcaggctc

SEQ ID NO: 4842 - DNA, 21 bp, Zea mays
ggtcatcgtcaacgtcagctc

SEQ ID NO: 4843 - DNA, 21 bp, Zea mays
tggacgcaacatgctgacgct

SEQ ID NO: 4844 - DNA, 21 bp, Zea mays
taggcacggcccgttcagccc

SEQ ID NO: 4845 - DNA, 21 bp, Zea mays
atatacccgaacccctaaccc

SEQ ID NO: 4846 - DNA, 21 bp, Zea mays
agtacgccacccagcagcttc

SEQ ID NO: 4847 - DNA, 21 bp, Zea mays
tgccgtcgcaacgcacgggca

SEQ ID NO: 4848 - DNA, 21 bp, Zea mays
ggcgcagacctcctcctggca

SEQ ID NO: 4849 - DNA, 21 bp, Zea mays
tcgtggccatccgaagtctcg

SEQ ID NO: 4850 - DNA, 21 bp, Zea mays
agagccgctttgttccagttc

SEQ ID NO: 4851 - DNA, 21 bp, Zea mays
agtgtctttgccgagtgcaat

SEQ ID NO: 4852 - DNA, 21 bp, Zea mays
attaagggcctgtttggttca

SEQ ID NO: 4853 - DNA, 21 bp, Zea mays
ccggagaagccagtccacgct

SEQ ID NO: 4854 - DNA, 21 bp, Zea mays
tggctgctcatcaactttccg

SEQ ID NO: 4855 - DNA, 21 bp, Zea mays
ttgcccgagtttcgcttcgac

SEQ ID NO: 4856 - DNA, 21 bp, Zea mays
gccctcattgctgcagtcccg

SEQ ID NO: 4857 - DNA, 21 bp, Zea mays
tccatggcagatggcttcgga

SEQ ID NO: 4858 - DNA, 21 bp, Zea mays
tcgtcctctaaacagtcctct

SEQ ID NO: 4859 - DNA, 21 bp, Zea mays
gtgggtgcccgtgcgttgcaa

SEQ ID NO: 4860 - DNA, 21 bp, Zea mays
cagtgcacagcctccctctcg

SEQ ID NO: 4861 - DNA, 21 bp, Zea mays
ccaaaagcactagctgagtct

SEQ ID NO: 4862 - DNA, 21 bp, Zea mays
tgctggagttagcctaacaat

SEQ ID NO: 4863 - DNA, 21 bp, Zea mays
gtccggccgagaaaatccccg

SEQ ID NO: 4864 - DNA, 21 bp, Zea mays
agcttctttgccgagtgctgt

SEQ ID NO: 4865 - DNA, 21 bp, Zea mays
gttgcgagaagcagacgattc

SEQ ID NO: 4866 - DNA, 21 bp, Zea mays
aacgtctttgccgagtgcccg

SEQ ID NO: 4867 - DNA, 21 bp, Zea mays
aagaccggcccatctatgcag

SEQ ID NO: 4868 - DNA, 21 bp, Zea mays
tagggcccgttcggttgtacc

SEQ ID NO: 4869 - DNA, 21 bp, Zea mays
cgtgggccttacgtcaggctc

SEQ ID NO: 4870 - DNA, 21 bp, Zea mays
ggagccacaaaaccggagggg

SEQ ID NO: 4871 - DNA, 21 bp, Zea mays
gccccaagggatcgttcagct

SEQ ID NO: 4872 - DNA, 21 bp, Zea mays
gaaacccggcagatagcgcga

SEQ ID NO: 4873 - DNA, 21 bp, Zea mays
cccgtcggccagagagtaggc

SEQ ID NO: 4874 - DNA, 21 bp, Zea mays
ctgcggacggcgattttggag

SEQ ID NO: 4875 - DNA, 21 bp, Zea mays
tgacaagcactcggcaaagac

SEQ ID NO: 4876 - DNA, 21 bp, Zea mays
tgcgtggcactcggcaaagag

SEQ ID NO: 4877 - DNA, 21 bp, Zea mays
ccagtcgccctgcactcagtc

SEQ ID NO: 4878 - DNA, 21 bp, Zea mays
ctcggcgtcatcatcattggc

SEQ ID NO: 4879 - DNA, 21 bp, Zea mays
gaaacttctttgccgagtgcc

SEQ ID NO: 4880 - DNA, 21 bp, Zea mays
atctagacactcggcaaagag

SEQ ID NO: 4881 - DNA, 21 bp, Zea mays
tccgacggccctgtacgaggc

SEQ ID NO: 4882 - DNA, 21 bp, Zea mays
agccaaccccacccttcgccg

SEQ ID NO: 4883 - DNA, 21 bp, Zea mays
acccgttgcaacgcacgggca

SEQ ID NO: 4884 - DNA, 21 bp, Zea mays
actacgagtcgagcgagctca

SEQ ID NO: 4885 - DNA, 21 bp, Zea mays
gctgtccttgcagtcaaaaga

SEQ ID NO: 4886 - DNA, 21 bp, Zea mays
cacattaagttcgacggtacc

SEQ ID NO: 4887 - DNA, 21 bp, Zea mays
cggttcaaccgccctagggcc

SEQ ID NO: 4888 - DNA, 21 bp, Zea mays
ggttcgccacccagcagcttc

SEQ ID NO: 4889 - DNA, 21 bp, Zea mays
ccgtctgtccaccctgctgac

SEQ ID NO: 4890 - DNA, 21 bp, Zea mays
tccaagcgatcaacagcctgc

SEQ ID NO: 4891 - DNA, 21 bp, Zea mays
ggtcgtgccggttctgggctg

SEQ ID NO: 4892 - DNA, 21 bp, Zea mays
gctccctttgccgagtgccag

SEQ ID NO: 4893 - DNA, 21 bp, Zea mays
catggccttgttcgtttgtgt

SEQ ID NO: 4894 - DNA, 21 bp, Zea mays
gaccggcggtacttactcctg

SEQ ID NO: 4895 - DNA, 21 bp, Zea mays
ggttgcgccaccggaccacca

SEQ ID NO: 4896 - DNA, 21 bp, Zea mays
accttccgccttggcggcctc

SEQ ID NO: 4897 - DNA, 21 bp, Zea mays
tggaaactcagggtggacagc

SEQ ID NO: 4898 - DNA, 21 bp, Zea mays
agtgcacccgccctaagtcct

SEQ ID NO: 4899 - DNA, 21 bp, Zea mays
gaatgtttgcagcccctcaca

SEQ ID NO: 4900 - DNA, 21 bp, Zea mays
tttggcgccaagatctatggc

SEQ ID NO: 4901 - DNA, 21 bp, Zea mays
ccggaccgccgtttggccatc

SEQ ID NO: 4902 - DNA, 21 bp, Zea mays
ccgcacggtactgcagtatgc

SEQ ID NO: 4903 - DNA, 21 bp, Zea mays
ctactttgccgagtgccagag

SEQ ID NO: 4904 - DNA, 21 bp, Zea mays
cagtagacactcggcaaagag

SEQ ID NO: 4905 - DNA, 21 bp, Zea mays
tacgtttggtttctagggact

SEQ ID NO: 4906 - DNA, 21 bp, Zea mays
taggtcgagcttccgaattcg

SEQ ID NO: 4907 - DNA, 21 bp, Zea mays
tgccgagtgtcatccagctgg

SEQ ID NO: 4908 - DNA, 21 bp, Zea mays
agatgcacgcgctactttatg

SEQ ID NO: 4909 - DNA, 21 bp, Zea mays
cccacactctccgtcgtgcaa

SEQ ID NO: 4910 - DNA, 21 bp, Zea mays
tccgtattcgtccgacaccag

SEQ ID NO: 4911 - DNA, 21 bp, Zea mays
atataggttctttgccgagtg

SEQ ID NO: 4912 - DNA, 21 bp, Zea mays
gtggcgaggtcggccgacgag

SEQ ID NO: 4913 - DNA, 21 bp, Zea mays
tgccctcgtcgacgctcctcc

SEQ ID NO: 4914 - DNA, 21 bp, Zea mays
cctgaacaggcccctcacgcg

SEQ ID NO: 4915 - DNA, 21 bp, Zea mays
ccctcccaccacaaccgcgca

SEQ ID NO: 4916 - DNA, 21 bp, Zea mays
cagcgggtctccgcctgagcg

SEQ ID NO: 4917 - DNA, 21 bp, Zea mays
aggcgctaacttcctacgaca

SEQ ID NO: 4918 - DNA, 21 bp, Zea mays
ggaccttctttgccgagtgcc

SEQ ID NO: 4919 - DNA, 21 bp, Zea mays
acggaagcttaacccggagac

SEQ ID NO: 4920 - DNA, 21 bp, Zea mays
gagctcatcgtagtggttgtc

SEQ ID NO: 4921 - DNA, 21 bp, Zea mays
gcttcgccagtatgccatcgg

SEQ ID NO: 4922 - DNA, 21 bp, Zea mays
gtggagctcgacgcagtcaca

SEQ ID NO: 4923 - DNA, 21 bp, Zea mays
ggactcctcgccgccgacgag

SEQ ID NO: 4924 - DNA, 21 bp, Zea mays
ggctagtgccgtgcctgggcc

SEQ ID NO: 4925 - DNA, 21 bp, Zea mays
atctcaggaatccccgccatc

SEQ ID NO: 4926 - DNA, 21 bp, Zea mays
cctcggcagaaccgtgcacca

SEQ ID NO: 4927 - DNA, 21 bp, Zea mays
gtcgcgcgcttcagcgccatc

SEQ ID NO: 4928 - DNA, 21 bp, Zea mays
cagtcgattaccaacgcagcc

SEQ ID NO: 4929 - DNA, 21 bp, Zea mays
gctgcgagaagcagacgattc

SEQ ID NO: 4930 - DNA, 21 bp, Zea mays
gtcggaatcgctcggtccacg

SEQ ID NO: 4931 - DNA, 21 bp, Zea mays
gagtgctcatgcgttgcaacg

SEQ ID NO: 4932 - DNA, 21 bp, Zea mays
cgcctcgaccacttcaccgga

SEQ ID NO: 4933 - DNA, 21 bp, Zea mays
ccgtagaaaccaaacaccccc

SEQ ID NO: 4934 - DNA, 21 bp, Zea mays
gttctttctttgccgagtgct

SEQ ID NO: 4935 - DNA, 21 bp, Zea mays
cgatcgtgccgggctggcccg

SEQ ID NO: 4936 - DNA, 21 bp, Zea mays
tgactgtttcttctggacggt

SEQ ID NO: 4937 - DNA, 21 bp, Zea mays
cccttcgctgaattccctcgg

SEQ ID NO: 4938 - DNA, 21 bp, Zea mays
tggtagacactcggcaaagag

SEQ ID NO: 4939 - DNA, 21 bp, Zea mays
aggtccagcactgacttcgac

SEQ ID NO: 4940 - DNA, 21 bp, Zea mays
aaagctcgcgctaacctgctc

SEQ ID NO: 4941 - DNA, 21 bp, Zea mays
ttctgcccggaggtcgttggt

SEQ ID NO: 4942 - DNA, 21 bp, Zea mays
gcagatccgtcgaagaagagc

SEQ ID NO: 4943 - DNA, 21 bp, Zea mays
cctgtggaggtcctggacctt

SEQ ID NO: 4944 - DNA, 21 bp, Zea mays
caagccagtctgccacagtca

SEQ ID NO: 4945 - DNA, 21 bp, Zea mays
tatgcgcagtggcaggggcgg

SEQ ID NO: 4946 - DNA, 21 bp, Zea mays
cagtacccgaacccctaaccc

SEQ ID NO: 4947 - DNA, 21 bp, Zea mays
ctcggcgccatagtctatggc

SEQ ID NO: 4948 - DNA, 21 bp, Zea mays
cgccgatcagccgtatcgcgg

SEQ ID NO: 4949 - DNA, 21 bp, Zea mays
cccatctttgccgagtgcctt

SEQ ID NO: 4950 - DNA, 21 bp, Zea mays
tttccttctttgccgagtgtc

SEQ ID NO: 4951 - DNA, 21 bp, Zea mays
ctgtctccagcagcgtcccct

SEQ ID NO: 4952 - DNA, 21 bp, Zea mays
cgcccaaacaggctgtcgggt

SEQ ID NO: 4953 - DNA, 21 bp, Zea mays
ccgagtgcccgaaataaaaca

SEQ ID NO: 4954 - DNA, 21 bp, Zea mays
ctccaccccgcagacgacgaa

SEQ ID NO: 4955 - DNA, 21 bp, Zea mays
ggcctcaaccctcctccgttg

SEQ ID NO: 4956 - DNA, 21 bp, Zea mays
ctgatctggcactcggcaaag

SEQ ID NO: 4957 - DNA, 21 bp, Zea mays
ctcctgctccccgctcaggcg

SEQ ID NO: 4958 - DNA, 21 bp, Zea mays
ccttagagcaactccaatagt

SEQ ID NO: 4959 - DNA, 21 bp, Zea mays
aacctctttgtcgagtgtcac

SEQ ID NO: 4960 - DNA, 21 bp, Zea mays
gtgacatactcggacggtccg

SEQ ID NO: 4961 - DNA, 21 bp, Zea mays
cgatgacactcggcaaaggct

SEQ ID NO: 4962 - DNA, 21 bp, Zea mays
gccgtcgcaacgcacgggcac

SEQ ID NO: 4963 - DNA, 21 bp, Zea mays
agctcgccgactgaccgtcgt

SEQ ID NO: 4964 - DNA, 21 bp, Zea mays
gttacgccctgcccagacgac

SEQ ID NO: 4965 - DNA, 21 bp, Zea mays
tatttggcactcggcaaagag

SEQ ID NO: 4966 - DNA, 21 bp, Zea mays
tgcaatcaaaccatccagagc

SEQ ID NO: 4967 - DNA, 21 bp, Zea mays
atatgtttggttcgtggctaa

SEQ ID NO: 4968 - DNA, 21 bp, Zea mays
gtttgcttgattcgtggtcag

SEQ ID NO: 4969 - DNA, 21 bp, Zea mays
aaagaggttctttgccgagtg

SEQ ID NO: 4970 - DNA, 21 bp, Zea mays
gcttgtggtgtgcaggtgtgg

SEQ ID NO: 4971 - DNA, 21 bp, Zea mays
tctgccgtaggaagttagcgg

SEQ ID NO: 4972 - DNA, 21 bp, Zea mays
cactcgccatcgtcggggtag

SEQ ID NO: 4973 - DNA, 21 bp, Zea mays
caacatcccactcgaccgtcc

SEQ ID NO: 4974 - DNA, 21 bp, Zea mays
gtccaccgctctggaggcctt

SEQ ID NO: 4975 - DNA, 21 bp, Zea mays
cgggcacacggtagcttcgcg

SEQ ID NO: 4976 - DNA, 21 bp, Zea mays
cgccaaccagcaccccgctgg

SEQ ID NO: 4977 - DNA, 21 bp, Zea mays
gacggccgaaggcttatgtcc

SEQ ID NO: 4978 - DNA, 21 bp, Zea mays
ctccgcatccaccgcaccacg

SEQ ID NO: 4979 - DNA, 21 bp, Zea mays
agcagccaggctcccaggaaa

SEQ ID NO: 4980 - DNA, 21 bp, Zea mays
tacatgcccgtgcgttgcgac

SEQ ID NO: 4981 - DNA, 21 bp, Zea mays
gctagcgtctctggtttgcct

SEQ ID NO: 4982 - DNA, 21 bp, Zea mays
ttacactcggcaaagcctttg

SEQ ID NO: 4983 - DNA, 21 bp, Zea mays
gccctcgaccacttcaccgga

SEQ ID NO: 4984 - DNA, 21 bp, Zea mays
acttctttgtcgagtgtcaca

SEQ ID NO: 4985 - DNA, 21 bp, Zea mays
tgtctgctcatcaactttccg

SEQ ID NO: 4986 - DNA, 21 bp, Zea mays
ctatgtttggttcgtggctaa

SEQ ID NO: 4987 - DNA, 21 bp, Zea mays
tttagcgccacagcctatggc

SEQ ID NO: 4988 - DNA, 21 bp, Zea mays
tgctcggcgccataggctgtg

SEQ ID NO: 4989 - DNA, 21 bp, Zea mays
cctcctccggttttgtggctc

SEQ ID NO: 4990 - DNA, 21 bp, Zea mays
tgggagccacaaaaccggagg

SEQ ID NO: 4991 - DNA, 21 bp, Zea mays
aatatggcactcggcaaagag

SEQ ID NO: 4992 - DNA, 21 bp, Zea mays
gagcggacgaccaagtctctg

SEQ ID NO: 4993 - DNA, 21 bp, Zea mays
gctcagccacccgccaatgat

SEQ ID NO: 4994 - DNA, 21 bp, Zea mays
ctcgaccgtccgattgcgtcc

SEQ ID NO: 4995 - DNA, 21 bp, Zea mays
cccggcccaagcacggcacgg

SEQ ID NO: 4996 - DNA, 21 bp, Zea mays
ctggccgtgctttttagtgcc

SEQ ID NO: 4997 - DNA, 21 bp, Zea mays
ccataaaaccggaggggattg

SEQ ID NO: 4998 - DNA, 21 bp, Zea mays
acgccacacgccgcggacgcg

SEQ ID NO: 4999 - DNA, 21 bp, Zea mays
tcatatcaagcgtttgacttt

SEQ ID NO: 5000 - DNA, 21 bp, Zea mays
aggcggactagagtcaagctc

SEQ ID NO: 5001 - DNA, 21 bp, Zea mays
gccaatttctgggtccgccac

SEQ ID NO: 5002 - DNA, 21 bp, Zea mays
tttgggggggggggggggggt

SEQ ID NO: 5003 - DNA, 21 bp, Zea mays
gcccagccacccgccaatgat

SEQ ID NO: 5004 - DNA, 21 bp, Zea mays
gcaccggtctgcttcccactc

SEQ ID NO: 5005 - DNA, 21 bp, Zea mays
cggcctgggtgcattctctat

SEQ ID NO: 5006 - DNA, 21 bp, Zea mays
ttcccgttgcaacgcacgagt

SEQ ID NO: 5007 - DNA, 21 bp, Zea mays
atttgcttgagccttcttctc

SEQ ID NO: 5008 - DNA, 21 bp, Zea mays
acaccgcttcccagacacatg

SEQ ID NO: 5009 - DNA, 21 bp, Zea mays
tccaaaaaccggaggggattg

SEQ ID NO: 5010 - DNA, 21 bp, Zea mays
gtaggcgccaagatctatggc

SEQ ID NO: 5011 - DNA, 21 bp, Zea mays
ctctctttgtcgagtgtcaca

SEQ ID NO: 5012 - DNA, 21 bp, Zea mays
gcccgtcgagcaacccagcaa

SEQ ID NO: 5013 - DNA, 21 bp, Zea mays
tcctccccgcaaagctcattc

SEQ ID NO: 5014 - DNA, 21 bp, Zea mays
gtagcgaaccaaacagaccct

SEQ ID NO: 5015 - DNA, 21 bp, Zea mays
cttggcgccacagatcttggc

SEQ ID NO: 5016 - DNA, 21 bp, Zea mays
tctcggcgccaagatctgtgg

SEQ ID NO: 5017 - DNA, 21 bp, Zea mays
cggtgccacagatcttggtgc

SEQ ID NO: 5018 - DNA, 21 bp, Zea mays
tactttgccgagtgtcaaaaa

SEQ ID NO: 5019 - DNA, 21 bp, Zea mays
gtctgtaacgcacggacactc

SEQ ID NO: 5020 - DNA, 21 bp, Zea mays
ccgagtcaccaaatcagccct

SEQ ID NO: 5021 - DNA, 21 bp, Zea mays
gactgtgtcgggccagcccgt

SEQ ID NO: 5022 - DNA, 21 bp, Zea mays
gctctttgccgagtgcttttt

SEQ ID NO: 5023 - DNA, 21 bp, Zea mays
gggtgcagccggactaagcac

SEQ ID NO: 5024 - DNA, 21 bp, Zea mays
ggcggcacatcgcctgtcagt

SEQ ID NO: 5025 - DNA, 21 bp, Zea mays
gtgatagcagcagttgcggtc

SEQ ID NO: 5026 - DNA, 21 bp, Zea mays
cggaaagcgcgcacgaccacg

SEQ ID NO: 5027 - DNA, 21 bp, Zea mays
cctgtcaaccgaacgggccct

SEQ ID NO: 5028 - DNA, 21 bp, Zea mays
tcgtacctcgacgtgaccgcc

SEQ ID NO: 5029 - DNA, 21 bp, Zea mays
ccgcagtccttgctgtctgcc

SEQ ID NO: 5030 - DNA, 21 bp, Zea mays
gtatatgggcctgtttggttc

SEQ ID NO: 5031 - DNA, 21 bp, Zea mays
cagccagcctaggatcgagtg

SEQ ID NO: 5032 - DNA, 21 bp, Zea mays
tcctgtcctctcctgcggaag

SEQ ID NO: 5033 - DNA, 21 bp, Zea mays
ttgacactcggcaaaaccttc

SEQ ID NO: 5034 - DNA, 21 bp, Zea mays
ccttgtcaccaaatcagccct

SEQ ID NO: 5035 - DNA, 21 bp, Zea mays
ccaggcaggggcggacccata

SEQ ID NO: 5036 - DNA, 21 bp, Zea mays
gcctgtaacgcacggacactc

SEQ ID NO: 5037 - DNA, 21 bp, Zea mays
tttgcttctttgccgagtgcc

SEQ ID NO: 5038 - DNA, 21 bp, Zea mays
catcgccggctcatagagtac

SEQ ID NO: 5039 - DNA, 21 bp, Zea mays
cctgcgcccgcaacaagtggg

SEQ ID NO: 5040 - DNA, 21 bp, Zea mays
ccggaaacagttctagaccag

SEQ ID NO: 5041 - DNA, 21 bp, Zea mays
gactctttgtcgagtgtcaca

SEQ ID NO: 5042 - DNA, 21 bp, Zea mays
cttgcttctttgccgagtgtc

SEQ ID NO: 5043 - DNA, 21 bp, Zea mays
caacgcacgggcatccaccta

SEQ ID NO: 5044 - DNA, 21 bp, Zea mays
tctttaaggccttgttcggtt

SEQ ID NO: 5045 - DNA, 21 bp, Zea mays
cggacgcaacatgctgacgct

SEQ ID NO: 5046 - DNA, 21 bp, Zea mays
aaggagggagggagggaggga

SEQ ID NO: 5047 - DNA, 21 bp, Zea mays
taggtcctcgtgccggagcaa

SEQ ID NO: 5048 - DNA, 21 bp, Zea mays
gccgatttgcacgagaggact

SEQ ID NO: 5049 - DNA, 21 bp, Zea mays
ctgcctgctctgcctcctgct

SEQ ID NO: 5050 - DNA, 21 bp, Zea mays
aacttctttgccgagtgcccg

SEQ ID NO: 5051 - DNA, 21 bp, Zea mays
gggcttgtttggttcatgact

SEQ ID NO: 5052 - DNA, 21 bp, Zea mays
gtcgttctcacatgggcttcg

SEQ ID NO: 5053 - DNA, 21 bp, Zea mays
cgactgcaaactaaaatgttt

SEQ ID NO: 5054 - DNA, 21 bp, Zea mays
accaacaggtcctccgagcaa

SEQ ID NO: 5055 - DNA, 21 bp, Zea mays
gggtgctccgccactgcgtgt

SEQ ID NO: 5056 - DNA, 21 bp, Zea mays
ttccctccggttttgtggctc

SEQ ID NO: 5057 - DNA, 21 bp, Zea mays
tgtgagccacaaaaccggagg

SEQ ID NO: 5058 - DNA, 21 bp, Zea mays
atccggggctacctcctgagc

SEQ ID NO: 5059 - DNA, 21 bp, Zea mays
tcacgagccgagtcgagccga

SEQ ID NO: 5060 - DNA, 21 bp, Zea mays
cggtcgattaccaacgcagcc

SEQ ID NO: 5061 - DNA, 21 bp, Zea mays
tggggcaatcggacagatcct

SEQ ID NO: 5062 - DNA, 21 bp, Zea mays
acagactttgccgagtgccag

SEQ ID NO: 5063 - DNA, 21 bp, Zea mays
ccggtcgccctgcactcagtc

SEQ ID NO: 5064 - DNA, 21 bp, Zea mays
ggctcaccacatcacaactcg

SEQ ID NO: 5065 - DNA, 21 bp, Zea mays
ggacctggagcactcctggaa

SEQ ID NO: 5066 - DNA, 21 bp, Zea mays
catcgggtctccgcctgagcg

SEQ ID NO: 5067 - DNA, 21 bp, Zea mays
tggtgcatcatgggttcattc

SEQ ID NO: 5068 - DNA, 21 bp, Zea mays
ggctgatccacggggaattgg

SEQ ID NO: 5069 - DNA, 21 bp, Zea mays
tgatccgagccgagctgacca

SEQ ID NO: 5070 - DNA, 21 bp, Zea mays
gtccgtcgctgaggacgcctc

SEQ ID NO: 5071 - DNA, 21 bp, Zea mays
gtcccactcgacagtccaacc

SEQ ID NO: 5072 - DNA, 21 bp, Zea mays
ctagtacagcagccactcggc

SEQ ID NO: 5073 - DNA, 21 bp, Zea mays
tggatcaccaaatcagccctt

SEQ ID NO: 5074 - DNA, 21 bp, Zea mays
ggtttacgcagtgcagtccct

SEQ ID NO: 5075 - DNA, 21 bp, Zea mays
gagccgacccaagcggagacg

SEQ ID NO: 5076 - DNA, 21 bp, Zea mays
ggcctgcagcgctagcgtcac

SEQ ID NO: 5077 - DNA, 21 bp, Zea mays
tccggtcaccaaatcagccct

SEQ ID NO: 5078 - DNA, 21 bp, Zea mays
agtcgggacgtcaggaccagg

SEQ ID NO: 5079 - DNA, 21 bp, Zea mays
gcacttactcctggcagctct

SEQ ID NO: 5080 - DNA, 21 bp, Zea mays
cccaacgcccagccatgcgcc

SEQ ID NO: 5081 - DNA, 21 bp, Zea mays
acctgagccctcgcagtctcg

SEQ ID NO: 5082 - DNA, 21 bp, Zea mays
tggccttccgtcctcggcacg

SEQ ID NO: 5083 - DNA, 21 bp, Zea mays
tcgacgccatagcctatggcg

SEQ ID NO: 5084 - DNA, 21 bp, Zea mays
cgaaaatcggtgcgtccggtg

SEQ ID NO: 5085 - DNA, 21 bp, Zea mays
cctcgatcgcaacgggtcgga

SEQ ID NO: 5086 - DNA, 21 bp, Zea mays
cctacgcccgcaacaagtggg

SEQ ID NO: 5087 - DNA, 21 bp, Zea mays
tccgagaggcacccgcaccag

SEQ ID NO: 5088 - DNA, 21 bp, Zea mays
gtcgttcgtcgagtgtttggc

SEQ ID NO: 5089 - DNA, 21 bp, Zea mays
tgagtgcccgtgcgttgcgac

SEQ ID NO: 5090 - DNA, 21 bp, Zea mays
tggggaagacaagcggtccag

SEQ ID NO: 5091 - DNA, 21 bp, Zea mays
aaagggcctctagctgagttg

SEQ ID NO: 5092 - DNA, 21 bp, Zea mays
ataagggcttgtttggtttgt

SEQ ID NO: 5093 - DNA, 21 bp, Zea mays
ttagctttgtgccgcactgtg

SEQ ID NO: 5094 - DNA, 21 bp, Zea mays
cggtgccccgcttccgaccca

SEQ ID NO: 5095 - DNA, 21 bp, Zea mays
ccgaaccgcctgggacatcac

SEQ ID NO: 5096 - DNA, 21 bp, Zea mays
gcatgtcggggctcagcaccc

SEQ ID NO: 5097 - DNA, 21 bp, Zea mays
gcccggcccaagcccgaaaag

SEQ ID NO: 5098 - DNA, 21 bp, Zea mays
agaggtggtaatggatcacga

SEQ ID NO: 5099 - DNA, 21 bp, Zea mays
gcaccgcttcccagacacatg

SEQ ID NO: 5100 - DNA, 21 bp, Zea mays
ccggcaacacggtccactcca

SEQ ID NO: 5101 - DNA, 21 bp, Zea mays
ggcttctttgccgagtgcctg

SEQ ID NO: 5102 - DNA, 21 bp, Zea mays
aggcactcggcaaagaaggct

SEQ ID NO: 5103 - DNA, 21 bp, Zea mays
tacgtaggaggcgctgtaggg

SEQ ID NO: 5104 - DNA, 21 bp, Zea mays
gccagaatcgctcggtccacg

SEQ ID NO: 5105 - DNA, 21 bp, Zea mays
catatagggcctgtttggttc

SEQ ID NO: 5106 - DNA, 21 bp, Zea mays
acaacgcacgggcactcacct

SEQ ID NO: 5107 - DNA, 21 bp, Zea mays
cagcatcccactcgaccgtcc

SEQ ID NO: 5108 - DNA, 21 bp, Zea mays
ccgatctggcactcggcaaag

SEQ ID NO: 5109 - DNA, 21 bp, Zea mays
cattctggtttgcagccggct

SEQ ID NO: 5110 - DNA, 21 bp, Zea mays
gactcgatctcgtcgtcgttc

SEQ ID NO: 5111 - DNA, 21 bp, Zea mays
ggagcgggcggcggctgatca

SEQ ID NO: 5112 - DNA, 21 bp, Zea mays
gcactcggcaaagagggctcg

SEQ ID NO: 5113 - DNA, 21 bp, Zea mays
ccgatcaccaaatcagccctt

SEQ ID NO: 5114 - DNA, 21 bp, Zea mays
tttctttgccgagtgcttttt

SEQ ID NO: 5115 - DNA, 21 bp, Zea mays
agctcaccacatcacaactcg

SEQ ID NO: 5116 - DNA, 21 bp, Zea mays
tcgtgcgactactctgggcca

SEQ ID NO: 5117 - DNA, 21 bp, Zea mays
tcctggaacatcgacaacctc

SEQ ID NO: 5118 - DNA, 21 bp, Zea mays
tcgtccgtcggatgctgccca

SEQ ID NO: 5119 - DNA, 21 bp, Zea mays
cgtcctgctagcctccagcct

SEQ ID NO: 5120 - DNA, 21 bp, Zea mays
ctgctggagagcgaaatagtg

SEQ ID NO: 5121 - DNA, 21 bp, Zea mays
cccgtgcgttgcaacgggaac

SEQ ID NO: 5122 - DNA, 21 bp, Zea mays
acagggagtccctcatggcct

SEQ ID NO: 5123 - DNA, 21 bp, Zea mays
gccatagtgccaccgggccgg

SEQ ID NO: 5124 - DNA, 21 bp, Zea mays
cttacacgcttgcacctaacg

SEQ ID NO: 5125 - DNA, 21 bp, Zea mays
gagctctttgccgagtgcccg

SEQ ID NO: 5126 - DNA, 21 bp, Zea mays
tattgtagactgcccccgcct

SEQ ID NO: 5127 - DNA, 21 bp, Zea mays
ccgccgccaccgcaaccaccg

SEQ ID NO: 5128 - DNA, 21 bp, Zea mays
taccaacgcagcctgatcagc

SEQ ID NO: 5129 - DNA, 21 bp, Zea mays
ggactgatttggtgattaggg

SEQ ID NO: 5130 - DNA, 21 bp, Zea mays
attcgtggctaactgtgtcac

SEQ ID NO: 5131 - DNA, 21 bp, Zea mays
tcgagggtaccgctgcgttcg

SEQ ID NO: 5132 - DNA, 21 bp, Zea mays
cgacgtggacgagccaacttc

SEQ ID NO: 5133 - DNA, 21 bp, Zea mays
cccgacccaaatgtacaccta

SEQ ID NO: 5134 - DNA, 21 bp, Zea mays
agatcgccaaccaggtcgcgg

SEQ ID NO: 5135 - DNA, 21 bp, Zea mays
gggtcatgggccacaacacgc

SEQ ID NO: 5136 - DNA, 21 bp, Zea mays
tttcctccggttttgtggctc

SEQ ID NO: 5137 - DNA, 21 bp, Zea mays
ttagagccacaaaaccggagg

SEQ ID NO: 5138 - DNA, 21 bp, Zea mays
gccaaaaaccggaggggattg

SEQ ID NO: 5139 - DNA, 21 bp, Zea mays
atcggcccaagcacggcacgg

SEQ ID NO: 5140 - DNA, 21 bp, Zea mays
gggcttgttcggttacaccaa

SEQ ID NO: 5141 - DNA, 21 bp, Zea mays
tacctagggcctgtttggttc

SEQ ID NO: 5142 - DNA, 21 bp, Zea mays
gtcgctcacgcggacaaggtt

SEQ ID NO: 5143 - DNA, 21 bp, Zea mays
ttgtccaccaactgcatcttg

SEQ ID NO: 5144 - DNA, 21 bp, Zea mays
gtataggttctttgccgagtg

SEQ ID NO: 5145 - DNA, 21 bp, Zea mays
ttgcgtgccgtgcctgggcca

SEQ ID NO: 5146 - DNA, 21 bp, Zea mays
ttgctggcccaggcacggcac

SEQ ID NO: 5147 - DNA, 21 bp, Zea mays
gtactttctttgccgagtgct

SEQ ID NO: 5148 - DNA, 21 bp, Zea mays
ccagcatccgacgacgacgcc

SEQ ID NO: 5149 - DNA, 21 bp, Zea mays
tttggtttgtggagtcactct

SEQ ID NO: 5150 - DNA, 21 bp, Zea mays
catccgtgccgggctggcccg

SEQ ID NO: 5151 - DNA, 21 bp, Zea mays
aaatccgaggctttgccgagt

SEQ ID NO: 5152 - DNA, 21 bp, Zea mays
cctctttgccgagagccaacg

SEQ ID NO: 5153 - DNA, 21 bp, Zea mays
ctcagcgccatagtctatggc

SEQ ID NO: 5154 - DNA, 21 bp, Zea mays
gcgagacgaccgttgaaactg

SEQ ID NO: 5155 - DNA, 21 bp, Zea mays
gacggcagttgtcgctccccc

SEQ ID NO: 5156 - DNA, 21 bp, Zea mays
tttgccctacgctccccgctc

SEQ ID NO: 5157 - DNA, 21 bp, Zea mays
tgttgttgcaacgcacgggca

SEQ ID NO: 5158 - DNA, 21 bp, Zea mays
ccgcatagcgcagacagccgt

SEQ ID NO: 5159 - DNA, 21 bp, Zea mays
tctgctccggttttgtggctc

SEQ ID NO: 5160 - DNA, 21 bp, Zea mays
tggcaacgcacgggcacctac

SEQ ID NO: 5161 - DNA, 21 bp, Zea mays
ttctttgccgagtgtcacact

SEQ ID NO: 5162 - DNA, 21 bp, Zea mays
tgaatgcccgtgcgttgctac

SEQ ID NO: 5163 - DNA, 21 bp, Zea mays
ccctgacactcggcaaagcac

SEQ ID NO: 5164 - DNA, 21 bp, Zea mays
ggcccagcccactaagaaaac

SEQ ID NO: 5165 - DNA, 21 bp, Zea mays
taggtgcccgtgcgttgcgac

SEQ ID NO: 5166 - DNA, 21 bp, Zea mays
tctggaccgtccgtggcacgg

SEQ ID NO: 5167 - DNA, 21 bp, Zea mays
aaggtcgccctgcactcagtc

SEQ ID NO: 5168 - DNA, 21 bp, Zea mays
gccttacgtcagactccgccc

SEQ ID NO: 5169 - DNA, 21 bp, Zea mays
cgaggccacgtcgacgccacg

SEQ ID NO: 5170 - DNA, 21 bp, Zea mays
gaccaagttatcccagcaacc

SEQ ID NO: 5171 - DNA, 21 bp, Zea mays
gtttagaaaccaaacaccccc

SEQ ID NO: 5172 - DNA, 21 bp, Zea mays
ccgcgctcggccggtcacgca

SEQ ID NO: 5173 - DNA, 21 bp, Zea mays
atgcacgcacgacttcgccta

SEQ ID NO: 5174 - DNA, 21 bp, Zea mays
gcctgcgcacgcaaccgctac

SEQ ID NO: 5175 - DNA, 21 bp, Zea mays
cctaggatcggcttacccatg

SEQ ID NO: 5176 - DNA, 21 bp, Zea mays
agctaaccccacccttcgccg

SEQ ID NO: 5177 - DNA, 21 bp, Zea mays
ctgaagcaggttgttgggtgc

SEQ ID NO: 5178 - DNA, 21 bp, Zea mays
cctggcccaacccacaaccag

SEQ ID NO: 5179 - DNA, 21 bp, Zea mays
gctcagatcaaccgacactcg

SEQ ID NO: 5180 - DNA, 21 bp, Zea mays
tcgggcgactactctgggcca

SEQ ID NO: 5181 - DNA, 21 bp, Zea mays
tcaaagcacggtccgacacga

SEQ ID NO: 5182 - DNA, 21 bp, Zea mays
gctcgcctcagcttcgctctg

SEQ ID NO: 5183 - DNA, 21 bp, Zea mays
agccaggctcaccagatacga

SEQ ID NO: 5184 - DNA, 21 bp, Zea mays
tgcccgccgtacgaagtcgtc

SEQ ID NO: 5185 - DNA, 21 bp, Zea mays
gtccgcttcgggagcgtcacc

SEQ ID NO: 5186 - DNA, 21 bp, Zea mays
ccagtcaccaaatcagccctt

SEQ ID NO: 5187 - DNA, 21 bp, Zea mays
aaggatggcgcagagccgaag

SEQ ID NO: 5188 - DNA, 21 bp, Zea mays
caagtcaagcccacggccagc

SEQ ID NO: 5189 - DNA, 21 bp, Zea mays
aagctggcactcggcaaagaa

SEQ ID NO: 5190 - DNA, 21 bp, Zea mays
tttagtgcgcactttgtcctc

SEQ ID NO: 5191 - DNA, 21 bp, Zea mays
tcgttgtgccacgccgtacca

SEQ ID NO: 5192 - DNA, 21 bp, Zea mays
cgcacctggtcggtacgtggt

SEQ ID NO: 5193 - DNA, 21 bp, Zea mays
accatggcactcggcaaagaa

SEQ ID NO: 5194 - DNA, 21 bp, Zea mays
tctcaagaaccctagagccta

SEQ ID NO: 5195 - DNA, 21 bp, Zea mays
caccgagcaacccagcgaggc

SEQ ID NO: 5196 - DNA, 21 bp, Zea mays
tcatccaccaactgcatcttg

SEQ ID NO: 5197 - DNA, 21 bp, Zea mays
cccctgacgcagcaccgttgg

SEQ ID NO: 5198 - DNA, 21 bp, Zea mays
aaactgctttcgttgagagtc

SEQ ID NO: 5199 - DNA, 21 bp, Zea mays
cgtgcttctttgccgagtgtc

SEQ ID NO: 5200 - DNA, 21 bp, Zea mays
gcgcctttgccgagtgtcacc

SEQ ID NO: 5201 - DNA, 21 bp, Zea mays
ctaggctcaatcgctgcaagc

SEQ ID NO: 5202 - DNA, 21 bp, Zea mays
accatccctgcaacctggttc

SEQ ID NO: 5203 - DNA, 21 bp, Zea mays
tcgcggccatccgaagtctcg

SEQ ID NO: 5204 - DNA, 21 bp, Zea mays
aagcactcggcaaagccgccg

SEQ ID NO: 5205 - DNA, 21 bp, Zea mays
agagcttctttgccgagtgcc

SEQ ID NO: 5206 - DNA, 21 bp, Zea mays
cgttgagcaacccagcgaggc

SEQ ID NO: 5207 - DNA, 21 bp, Zea mays
tctgcgcacctggtcggtacg

SEQ ID NO: 5208 - DNA, 21 bp, Zea mays
atacgcagcacgcctcagctt

SEQ ID NO: 5209 - DNA, 21 bp, Zea mays
cttgccctacgctccccgctc

SEQ ID NO: 5210 - DNA, 21 bp, Zea mays
gagagcgcagcaaaacgggtg

SEQ ID NO: 5211 - DNA, 21 bp, Zea mays
ggacactcggcaaagccgccg

SEQ ID NO: 5212 - DNA, 21 bp, Zea mays
gagacttctttgccgagtgtc

SEQ ID NO: 5213 - DNA, 21 bp, Zea mays
ggaatccgagcctttgccgag

SEQ ID NO: 5214 - DNA, 21 bp, Zea mays
gaggtcagctcggctcggctc

SEQ ID NO: 5215 - DNA, 21 bp, Zea mays
tggtagatcggaccttggtcc

SEQ ID NO: 5216 - DNA, 21 bp, Zea mays
gtcgtcgaccacttcaccgga

SEQ ID NO: 5217 - DNA, 21 bp, Zea mays
tagctccccaaacccgtcccc

SEQ ID NO: 5218 - DNA, 21 bp, Zea mays
aagtccaccacctgttttgac

SEQ ID NO: 5219 - DNA, 21 bp, Zea mays
gacaggcggtacttactcctg

SEQ ID NO: 5220 - DNA, 21 bp, Zea mays
ttcctagggaagccaccgttg

SEQ ID NO: 5221 - DNA, 21 bp, Zea mays
gacgtcctcgtcggtcaaccc

SEQ ID NO: 5222 - DNA, 21 bp, Zea mays
cgacgcgtcgtcgtcgtcgtc

SEQ ID NO: 5223 - DNA, 21 bp, Zea mays
gcggccgtaggaagttagcgg

SEQ ID NO: 5224 - DNA, 21 bp, Zea mays
gcccagaacaacccgagagtc

SEQ ID NO: 5225 - DNA, 21 bp, Zea mays
ctcttagggtgcgtttggttg

SEQ ID NO: 5226 - DNA, 21 bp, Zea mays
gacatgcctgcctgcctgcct

SEQ ID NO: 5227 - DNA, 21 bp, Zea mays
tgatcctggtcctcctcttgg

SEQ ID NO: 5228 - DNA, 21 bp, Zea mays
ccacaccgcacacaaagtcca

SEQ ID NO: 5229 - DNA, 21 bp, Zea mays
tagccacaaaccaaacaggcc

SEQ ID NO: 5230 - DNA, 21 bp, Zea mays
atgagtgcccgtgcgttgcaa

SEQ ID NO: 5231 - DNA, 21 bp, Zea mays
tcacccctctgtaatgggcct

SEQ ID NO: 5232 - DNA, 21 bp, Zea mays
gattcgccctgttggccccac

SEQ ID NO: 5233 - DNA, 21 bp, Zea mays
gagccttctttgccgagtgcc

SEQ ID NO: 5234 - DNA, 21 bp, Zea mays
cagcagacactcggcaaagag

SEQ ID NO: 5235 - DNA, 21 bp, Zea mays
cggagctccggctgcgcaaga

SEQ ID NO: 5236 - DNA, 21 bp, Zea mays
ccaggctcaatcgctgcaagc

SEQ ID NO: 5237 - DNA, 21 bp, Zea mays
tcctagaaaccaaacaccccc

SEQ ID NO: 5238 - DNA, 21 bp, Zea mays
aaaacttctttgccgagtgcc

SEQ ID NO: 5239 - DNA, 21 bp, Zea mays
ccccgttcgcgtccaggcctc

SEQ ID NO: 5240 - DNA, 21 bp, Zea mays
aaccctaagacaaaaccgcct

SEQ ID NO: 5241 - DNA, 21 bp, Zea mays
gatctggcactcggcaaagaa

SEQ ID NO: 5242 - DNA, 21 bp, Zea mays
actgagaggcacccgcaccag

SEQ ID NO: 5243 - DNA, 21 bp, Zea mays
actcagccacccgccaatgat

SEQ ID NO: 5244 - DNA, 21 bp, Zea mays
cacgatgggccggcccaggca

SEQ ID NO: 5245 - DNA, 21 bp, Zea mays
tgtcaggttctttgccgagtg

SEQ ID NO: 5246 - DNA, 21 bp, Zea mays
gccctgtttgggacagctgct

SEQ ID NO: 5247 - DNA, 21 bp, Zea mays
aaaatctttgccgagtgcccg

SEQ ID NO: 5248 - DNA, 21 bp, Zea mays
acgatctttgccgagtgctcg

SEQ ID NO: 5249 - DNA, 21 bp, Zea mays
tccgtcgcaacgcacggacac

SEQ ID NO: 5250 - DNA, 21 bp, Zea mays
aagctctttgccgagtgcccg

SEQ ID NO: 5251 - DNA, 21 bp, Zea mays
agttgtttggttcgtggctaa

SEQ ID NO: 5252 - DNA, 21 bp, Zea mays
ttctttaccgagtgtctgaag

SEQ ID NO: 5253 - DNA, 21 bp, Zea mays
gtgggaccgtctgtgtctatg

SEQ ID NO: 5254 - DNA, 21 bp, Zea mays
aagaattcatggtcggtcagt

SEQ ID NO: 5255 - DNA, 21 bp, Zea mays
ggagcgcgcagtcacagccag

SEQ ID NO: 5256 - DNA, 21 bp, Zea mays
gttttggcactcggcaaagaa

SEQ ID NO: 5257 - DNA, 21 bp, Zea mays
accacccaacccctgttaggg

SEQ ID NO: 5258 - DNA, 21 bp, Zea mays
gccgagcgaagtctccccttc

SEQ ID NO: 5259 - DNA, 21 bp, Zea mays
gaacggcactcggcaaagaca

SEQ ID NO: 5260 - DNA, 21 bp, Zea mays
ccccatacccgctacccgatg

SEQ ID NO: 5261 - DNA, 21 bp, Zea mays
gcttctccgctgctcctctgc

SEQ ID NO: 5262 - DNA, 21 bp, Zea mays
tggtcccggtccaggggttgt

SEQ ID NO: 5263 - DNA, 21 bp, Zea mays
cgggtctttgccgagtgctcg

SEQ ID NO: 5264 - DNA, 21 bp, Zea mays
ctagggcctgtttggttcggc

SEQ ID NO: 5265 - DNA, 21 bp, Zea mays
cgccagcttggcctccgcctg

SEQ ID NO: 5266 - DNA, 21 bp, Zea mays
cacccaatctcactcaatcca

SEQ ID NO: 5267 - DNA, 21 bp, Zea mays
cggcctcacgcgagcctgctc

SEQ ID NO: 5268 - DNA, 21 bp, Zea mays
tctggcactcggcaaagacct

SEQ ID NO: 5269 - DNA, 21 bp, Zea mays
atcgtcattagcgccatctcc

SEQ ID NO: 5270 - DNA, 21 bp, Zea mays
ccgtggatcagcccggtctgg

SEQ ID NO: 5271 - DNA, 21 bp, Zea mays
ggggtggctcggggagactct

SEQ ID NO: 5272 - DNA, 21 bp, Zea mays
ctcgtggctcgctcggttcat

SEQ ID NO: 5273 - DNA, 21 bp, Zea mays
cccaaacccatacccgcgaag

SEQ ID NO: 5274 - DNA, 21 bp, Zea mays
gtggtacttactcctgacagc

SEQ ID NO: 5275 - DNA, 21 bp, Zea mays
tggctctgcccgaggcaaggc

SEQ ID NO: 5276 - DNA, 21 bp, Zea mays
ccgcctgtccaccctgctgac

SEQ ID NO: 5277 - DNA, 21 bp, Zea mays
gcgcgcgtcgtcgtcgtcgtc

SEQ ID NO: 5278 - DNA, 21 bp, Zea mays
tacctcggcgccatagatctt

SEQ ID NO: 5279 - DNA, 21 bp, Zea mays
ctcccccgtgctgccgctgtc

SEQ ID NO: 5280 - DNA, 21 bp, Zea mays
tcagtccagcgctacagaacc

SEQ ID NO: 5281 - DNA, 21 bp, Zea mays
agctcggcgccacagatcttg

SEQ ID NO: 5282 - DNA, 21 bp, Zea mays
agatctgtggcgccgagctag

SEQ ID NO: 5283 - DNA, 21 bp, Zea mays
ataagaaggccgagcccaccg

SEQ ID NO: 5284 - DNA, 21 bp, Zea mays
ttctgttgcaacgcacgggca

SEQ ID NO: 5285 - DNA, 21 bp, Zea mays
ctcccagactccgcatccctc

SEQ ID NO: 5286 - DNA, 21 bp, Zea mays
aagacttctttgccgagtgtc

SEQ ID NO: 5287 - DNA, 21 bp, Zea mays
aaagactttgccgagtgccag

SEQ ID NO: 5288 - DNA, 21 bp, Zea mays
ccgacgaaggaaggtgcgcag

SEQ ID NO: 5289 - DNA, 21 bp, Zea mays
ttcagcactcggcaaagacct

SEQ ID NO: 5290 - DNA, 21 bp, Zea mays
attctctttgtcgagtgtcac

SEQ ID NO: 5291 - DNA, 21 bp, Zea mays
tctttagggtgcgtttggttg

SEQ ID NO: 5292 - DNA, 21 bp, Zea mays
ccgtgcctcgtgctggtccat

SEQ ID NO: 5293 - DNA, 21 bp, Zea mays
catgccctacgctccccgctc

SEQ ID NO: 5294 - DNA, 21 bp, Zea mays
tcatcctggccagccagatac

SEQ ID NO: 5295 - DNA, 21 bp, Zea mays
cagcagactccggtcgagacg

SEQ ID NO: 5296 - DNA, 21 bp, Zea mays
tcggaaacagttctagaccag

SEQ ID NO: 5297 - DNA, 21 bp, Zea mays
tgatttgggccggcctattag

SEQ ID NO: 5298 - DNA, 21 bp, Zea mays
cacaatttctggcacggccca

SEQ ID NO: 5299 - DNA, 21 bp, Zea mays
aaagcatccgacgacgacgcc

SEQ ID NO: 5300 - DNA, 21 bp, Zea mays
ttcacgatggccagcttgttc

SEQ ID NO: 5301 - DNA, 21 bp, Zea mays
tgtgtggcactcggcaaagag

SEQ ID NO: 5302 - DNA, 21 bp, Zea mays
gccatcgaccctcctgtacgc

SEQ ID NO: 5303 - DNA, 21 bp, Zea mays
ctcaccctctgtaatgggcct

SEQ ID NO: 5304 - DNA, 21 bp, Zea mays
tgctggacgcacgacttcgcc

SEQ ID NO: 5305 - DNA, 152 bp, Zea mays
cgactattattagggctagtttgggagtccaaaaaccggaggggattagagaggctaaataccctttttattcaaaattgaataaggaggaaattttagcccctccgaccccttccagttttgtggctttcaaactagcccttaatgggttg

SEQ ID NO: 5306 - DNA, 102 bp, Zea mays
cttgttcgctgcggcttgctgcggctgcaatccggctgcggctgcggcttctacagtatttttctctctatggattgcagctgcagcagtccaaacagctgc

SEQ ID NO: 5307 - DNA, 149 bp, Zea mays
ctacttgactaaggccttgttcgtttgtattcgattgcacctggaatcgttccacctaatcagagtttatataaattagagaagcaatccggttagaaatcgttttgaccaaccaatccggcacaaacgaatcaggcctaataggttgc

SEQ ID NO: 5308 - DNA, 123 bp, Zea mays
  unsure (50)..(51)..(52)..(53)..(54)..(55)..(56)..(57)..(58)..(59): n = A, C, G or T
  unsure (61): n = A, C, G or T
tcgtgtcgtgtgtgcctggctccctgtatgccacacatgtagccaacctnnnnnnnnnngncaacccgtggcgtgattggatgctgtgggtggcgtgcaaggagccaagcatgcataacaggc

SEQ ID NO: 5309 - DNA, 71 bp, Zea mays
tttattagcgtttgttatgtgaatttgtgcactaaggtgtgtgtcaaaaacaggtggtggacttccggatc

SEQ ID NO: 5310 - DNA, 227 bp, Zea mays
tagtggcggcgacgacgacgacgatgacccagtgggccagatcctcgagtccccaaacctcaagatatacaccttcgcggagctcaagagcgccaccaggaacttcaggccggagacggtgctcggggagggcgggttcggcaaggtgtacaagggctgggtcgatgagaagaccatgaacccatccaaggctagcactggcgtcatggtcgccgtcaagaagctca

SEQ ID NO: 5311 - DNA, 147 bp, Zea mays
tctgatcatataccaggatgggagatgctcaccaagtgatcgtcatttaacaacactgacttagtgttatcccaggttgtaatttttgttctgttgtggatggtgctaagtgccggtgggctcggccttcttatatatgtgtatctc

SEQ ID NO: 5312 - DNA, 239 bp, Zea mays
  unsure (84)..(85)..(86)..(87)..(88)..(89)..(90)..(91)..(92)..(93): n = A, C, G or T
ccggagaaggtggcggccgccgtgtttgtcaccgcgttcctgccggactgcaccaacccgcgctcgcaggtcatcgagaaggtnnnnnnnnnncgcgctcgcaggtcatcgagaaggtagtacacgtgtacgcttgttgctgttggtctttcagtttagctaacggaagagctgaccctgatgccgacatgaatggtctcccctgttccggccggccggccggccgtcactaccgtcga

SEQ ID NO: 5313 - DNA, 252 bp, Zea mays
  unsure (122)..(123)..(124)..(125)..(126)..(127)..(128)..(129)..(130)..(131): n = A, C, G or T
ttcctttttgccctggactcttctgttttccttcttwacgagaggaagctgtttctggtacaatgcagaaagaaggcttctggtaatttttagaagttggtgttaagtaaccctagttaggnnnnnnnnnnaggttagggttatgtgggcaaatccctgctttgcccctgaggggtttcacatttttatataaggaacctgtacaccccttcatatgacagagatcagaaagagaccagaggcccaccccta

SEQ ID NO: 5314 - DNA, 177 bp, Zea mays
tggtagctctggtagccaaggatgacttgcctgtgtgctggccacgctcccctcatgcaaggaccatctcgtgtcgaccgacgagcgagcgagcgatcgatcgatgagaggatgacgaagcttggggtgtacgttggtctctcacgggcagtctccttggctagccctgactcactc

SEQ ID NO: 5315 - DNA, 74 bp, Zea mays
  unsure (66)..(67)..(68)..(69)..(70)..(71)..(72)..(73)..(74): n = A, C, G or T
ccaaacaaaaaacagagccgctccgttccagtttaccaaacacagaacagagcggctccgttcctnnnnnnnnn

SEQ ID NO: 5316 - DNA, 182 bp, Zea mays
  unsure (99)..(100)..(101)..(102)..(103)..(104)..(105)..(106)..(107)..(108): n = A, C, G or T
gcgtgcaatcaaactatccagagcatccaatctagatccaacggtttcatatggaagtggttaaaattaaaataggtactatgttttaggtgtaaggtnnnnnnnnnntggaaggggttaaatataaaataacagtcatcattagatctagatcggatgcaccagatcgcttgattgcatgc

SEQ ID NO: 5317 - DNA, 198 bp, Zea mays
ggcggcggcgcccggctctgctcggacggactccaccgaaggctcggctcccctcggactccacctgcgacggccggccctctgcctgcaccgacggtgcccggctccctcggcatccaccagcggtgcccgactccaagaaatgtacaagtcacggctgcaggagctgtgccagaagcggcgatgggcgccgccgtt

SEQ ID NO: 5318 - DNA, 90 bp, Zea mays
caatacacatggattgaatgggtttggaaaaaattatgaagaagtttgacttgcgtgggattcaaacccatccaatcccactcaatccac

SEQ ID NO: 5319 - DNA, 125 bp, Zea mays
gacaaaatactcgtggctgataagctcattgttgactcgactcgttttcaattttatcgcgagctaaactaccatcttagctcggtttgttaaggagccagctcgttagctcgaactagcaacta

SEQ ID NO: 5320 - DNA, 153 bp, Zea mays
atttgacatgcttcggaagctgtggcggaactgcccgaattattccaacttaagtgtccaagtcccgccttagaggctagaccacacttaaatgggaataacccgtcaatccctcggatctagtccgacacggccactgacaggatcaagtac

SEQ ID NO: 5321 - DNA, 71 bp, Zea mays
ttgcataacctttctgcctaaggttaattgttcaatacagacgactaaccttaggcaaaatgtggcacatt

SEQ ID NO: 5322 - DNA, 243 bp, Zea mays
cgcaaaggcgtggtcgttctcctcgagcatcgatttagggttcttcggctttctatgatcaggaggagttgctggattattttatcagggaacagaatggtgtgattcgttgattggattacagtctggatctctcttgcatcaaatggttgagcaaggcaaaccacgaagcatcccgacgaaggcgaagaaatcgccgttcgtggaggtagaggttgacgagattggccaggctagtggggt

SEQ ID NO: 5323 - DNA, 86 bp, Zea mays
  unsure (39)..(40)..(41)..(42)..(43)..(44)..(45)..(46)..(47)..(48): n = A, C, G or T
tttctgtcatggcttcattctggttcagctgccgctctnnnnnnnnnnatggattgagagctaaccgaacaagcccgtagtgggat

SEQ ID NO: 5324 - DNA, 109 bp, Zea mays
ggttcgtgcctaaatatgccacactttacctaaggttagtcgttcgaattgaagaactaaccttagacacaaaagttaggcaaagtgtggcaagttaaccatcaaacca

SEQ ID NO: 5325 - DNA, 142 bp, Zea mays
tgatcccctaagggctaatttggtgattagggatccctaggggatccatgggggaggaatcccctcgcaatttaattttgaatagcaagaggatttcttcccctcgggatccccggtcaccaaattaaccctaaaggcctat

SEQ ID NO: 5326 - DNA, 148 bp, Zea mays
aattcatattaggtcttgttcgtttccgtcggattggacccggaatcgttcgagctaatcaaagtttatataaattagagaagcaatccggttatgaattgttccgacccatcaatccggcacaaacgaacaaagtcttaatgaaata

SEQ ID NO: 5327 - DNA, 76 bp, Zea mays
tggctgggctcaccgactgcaacccagctctcactccgatggaggagaggctgaagttgagtcgcgacagcacgac

SEQ ID NO: 5328 - DNA, 117 bp, Zea mays
ggtatttcttgctgagtaattgcgtactcagggttttattccctgttgtttttcaggttatatttttgttctgttgtggatggtgctaagtgccggtgggctcggccttcttatata

SEQ ID NO: 5329 - DNA, 152 bp, Zea mays
  unsure (1)..(2)..(3)..(4): n = A, C, G or T
nnnngatttattcgggtcttgttcgtttgtgccggattgatgtcagaacgatttctaaccggattgtttctctaatttatataaattttaattagctagaacgatttcggatgcaatccgacacaaacgaacaagacctcagttgactaaaa

SEQ ID NO: 5330 - DNA, 235 bp, Zea mays
gaggagcgtctggcgcgcctccgcggcgaggcggcggcgtggcaggccaaggcgctctccgagcaggccgccgcggtcgccctgcacgcgcagctgcagcaggccgcggccgcggcgcgggcgtcggtcgaggagctcaccgccgccgccgccgcgggcgacgccggcccggcggagtcgtcggcgtcggcgttcgtggaccctcgccgcgccgggccgccgccagaccacgcgt

SEQ ID NO: 5331 - DNA, 148 bp, Zea mays
  unsure (1)..(2)..(3): n = A, C, G or T
nnnttactaagggcctgtttggtttgtggctaactatgccacactctgtctaaggttagtcgttcaaattggagaactaaccttagacagaaaagttaggcaaagtgtgacaagttaggcagcgaaccaaacaaaccctaaaatttaa

SEQ ID NO: 5332 - DNA, 110 bp, Zea mays
tggttcgtatctaaatgtgccacactttgcctaagattagtcgttcgaattgaagaactacccttaggcataaaagttaggcaaagtgtggcaacttaggcataaccaaa

SEQ ID NO: 5333 - DNA, 259 bp, Zea mays
  unsure (63)..(64)..(65)..(66)..(67)..(68)..(69)..(70)..(71)..(72): n = A, C, G or T
ttgacggcgtcgtcgtcggcgcggacgagagctacgagctgccggtcgtcgacatggccagtnnnnnnnnnncactacccgccctgccgccagcgggagaaggtgatgggcatcacgccgcacacggacgggctgggcctcacgctgctgctgcacgtggacgacacgcccggcctgcagatccgcaggggcggcaggtggttccccgtgcgcccgctgccgggcgccttcgtcgtcaacgtcgccgacatcctggacg

SEQ ID NO: 5334 - DNA, 212 bp, Zea mays
gtcatagaattaggccctgtttggaagcaacctagtttttaagagactgcttttatcttttacctaagagagtctagcttcttggtttttaagaaactaagaatctaatttctataaactgagttctaaactgatatgtttggaagaacctcaatttctataaagcagtttcttaaaaattgggtgcttccaaatagggccttagacggcca

SEQ ID NO: 5335 - DNA, 72 bp, Zea mays
agggtcataacactcggcaaagagccaaaacttgggcaccggtttaggtactttgctgagtgttatgtcgct

SEQ ID NO: 5336 - DNA, 120 bp, Zea mays
aagcttgcctctttgccgagtgccagcgacataacactcagcaaagtacctaaaccggtgcccaagttttggctctttgccgagtgttatgaccctgacactcggcaaagcgcctctttg

SEQ ID NO: 5337 - DNA, 226 bp, Zea mays
gatcaggatgcagagctcccttcaatccaaagagcggccagcaagggggcggtgcagctcctcgggtcatgcaaaccacaagcctatctcaaagacgagagaaaccctcccccatggattacatatatacacatgatgagataggatagtgggaaccatgaacgagcagcggaaccagcccttcggaacgacccttcattggaatgataggagctccgcttcaaac

SEQ ID NO: 5338 - DNA, 138 bp, Zea mays
aattccgctttactttgatgtgatacttgttaaagatacaatgttcagatgatgtaataaagtattatactctctttacgcctttattgcattgtcttttgatatattacacttgtgacgtcaacatatgtgtggaaa

SEQ ID NO: 5339 - DNA, 119 bp, Zea mays
tcgtgctcggtggagaagatgggcacatgaagaaccatccatccacccacccacccagctgatggagctcggcggcattggatggtaatgcacgtgccctgcttctccaccacgcacag

SEQ ID NO: 5340 - DNA, 219 bp, Zea mays
agacagcgcagatttgcgcgtgtttgagagtagctaaggctaatgtaaaacaaaactcggaaaataaaggaggcgcagctcctgtataaatagagagggggcgcagcccctaggggcggccaaccctaggtcgtccattatgggccgcaattgggctggtcgtctattcttccgggccttcgttctttaacaacatgatgtagttcaattctcttgcac

SEQ ID NO: 5341 - DNA, 143 bp, Zea mays
aagttgggtgtcaaaaacaggtggtggacttccggatcgttcttagggattttgcccgaacttcggtaaaggcaagtaaatacagtggtggttgctaccatttggtttgcatcctattccctgtcattgagtatgcataagtt

SEQ ID NO: 5342 - DNA, 94 bp, Zea mays
aatctgaggactgatttggtgaccagggatcacgagtggatccatggtgaatgatcccctcgtgatctctggttaccaaaccagccctaaggtc

SEQ ID NO: 5343 - DNA, 119 bp, Zea mays
attgacgaatctggaccctatgctcgggactgggtcacctggaagcagattttcttgctggttgatgtgatctgctgctgtgctgtgctcttcccgattgtgtggtccatcaagaacct

SEQ ID NO: 5344 - DNA, 197 bp, Zea mays
tcacacatttggtgcaagcatgcaatcaaatcatccaggaatccaatctagatccaacggtttcatatgaaatggggttaaatgtaaaaataagtacaaggttgctggtttcacgcggaaggagttaaaggtaaactagcagttactattggattttcattggatgaatttgattgcttgattgcacgcatgcacaa

SEQ ID NO: 5345 - DNA, 94 bp, Zea mays
gagcgcgcgcaggagcccgacgtctgcatcttcccctggtaccccaccacggggtaccccgtgaacagcaggccgttgttcttcagcccgttgc

SEQ ID NO: 5346 - DNA, 226 bp, Zea mays
cgcttcctcctcgtcgtcaaccgccgccgcccccacgccttcttccaaccctttgcacgagccgaggcctctccacctctcgctcaagcccgtcttacccctccccaaaccgcatgcgctctcctgctccgcgccgcacatcccccgcgccgccgctggggacggatcgggcgtcgggaatggaggcaaggatggaggcggcggcgggggtggcgaggatgaagac

SEQ ID NO: 5347 - DNA, 79 bp, Zea mays
  unsure (36)..(37)..(38)..(39)..(40)..(41)..(42)..(43)..(44)..(45): n = A, C, G or T
ctgtcatggcttcattctggttcagctgccgctctnnnnnnnnnnatggattgagagctaaccgaacaagcccgtagtg

SEQ ID NO: 5348 - DNA, 148 bp, Zea mays
gctagtagtagggcctgtttggtttgatggttaacttgccacactttgcctaacttttgtgtctaaggttagttcttcaattcgaacgactaaccttaggtaaagtgtggcatatttaggcacgaaccaaacagccccgtagtcctct

SEQ ID NO: 5349 - DNA, 93 bp, Zea mays
ggtccgtccgggcgtagtgcacgtggaagcagcgcttacaggagctgcatgaggcggcgcgcgggcttcttcttgcgcaggccgacgagcgag

SEQ ID NO: 5350 - DNA, 108 bp, Zea mays
tacttcttatcagtggcggacgcaggacgaaaattcagggggggctaaaaaggccacatgagagacatgattttctagttcgccatgtccgtcgatcgcatgagacaa

SEQ ID NO: 5351 - DNA, 85 bp, Zea mays
ctcaggctcgggctcgggctctcagcgacggcgtcagcggcttcccctcccgcctctcgctagtcgactcgcgccctcgcatccg

SEQ ID NO: 5352 - DNA, 176 bp, Zea mays
gcggcgggcacgaggccgcgggcgggtggcgccggtcggcgggccacgcggacgccaagcgcagccccggcggcgacgccggaggggccgcggcgcgcgccgtgtgcgtcacgggagggatctccttcgtcgggttcgccgtcgtcgaccgcctcctccggcacgggtacaccgtc

SEQ ID NO: 5353 - DNA, 108 bp, Zea mays
gtgtgcttggcggtgaggtcgttggcgctgtggatggggtcgtcgcagtcggggcacaggatggcgcggtcctccacgcagaacacgaggcccctccgctcctgcaag

SEQ ID NO: 5354 - DNA, 238 bp, Zea mays
ttcaaacgggaggcagaaccaggggaggaagcttaccccttaaatcttcatagtagtagagatatatgcatggacacgtaactatatccagataatagatgaattggtaaaggactcaataacattgatgtggggatttcttatcctcttcttgtcaagcttgattgcgtaaggtggtggcctttgggatctagtacagaaacgtgccaatctccccctcgatctgcccctaatgttg

SEQ ID NO: 5355 - DNA, 85 bp, Zea mays
cgtactgcaggggcagtagggtcactgcgcgcgggccctgtcgcacgcgggggccacgcggcagtgcccaccccccacgtcagag

SEQ ID NO: 5356 - DNA, 122 bp, Zea mays
gcaagcttgcctctttgccgagtgccagcgacataacactcagcaaagtacctaaaccggtgcccaagttttggctctttgccgagtgttatgaccctgacactcggcaaagcgcctctttg

SEQ ID NO: 5357 - DNA, 150 bp, Zea mays
acacattatgagaccttgttcgtttgtgtcggtttggtgggtcggaataaatcttagccgaattgcttctctaatttatataaactttgattagctggaacgattccggatgcaatccgacacaaacgaacaaggcctaagtttgctgca

SEQ ID NO: 5358 - DNA, 212 bp, Zea mays
tgcaagcattcattagatgcaagcgtgcaagcagctcttttaatacattggatctaaatccaactatatgtgtaattgtggtttgttagggactttttttataaaagtacacgagtggtggtgggtaggatttaaatattaaatatagcatacggttagatctagcggaccaaaagatctgcttgcacgcttgcacataatggatgcttgca

SEQ ID NO: 5359 - DNA, 141 bp, Zea mays
cctccaatagcagccataactccattgaagaatatggcaacggtctgctcattagctgttggaggaagtccacccacatagacacgccgagcatgccgggtagcctgttgtgtcatggcttgtggctgaataacaaggggg

SEQ ID NO: 5360 - DNA, 87 bp, Zea mays
tctcactaggtgagtgcccatgcgttacaacggggacttatgtattatatgtctccgttgcaacgcacggacatatacctagtgaaa

SEQ ID NO: 5361 - DNA, 134 bp, Zea mays
ataaaaccttgttcgtttccgtcggattacacccggaatcgttacagctaatcaaagtttatataaattagagaagcaatccggccagaaatcgttccgacccatcaatccggtagaaacgaacaaggtctaat

SEQ ID NO: 5362 - DNA, 134 bp, Zea mays
attaggtcttgttcgtttccgtcggattggacccggaatcgttcgagctaatcaaagtttatataaattagagaagcaatccggttatgaattgttccgacccatcaatccggcacaaacgaacaaagtcttaa

SEQ ID NO: 5363 - DNA, 199 bp, Zea mays
tagatactaagggggtgtttggtttctagtgactaatttttagtccctacattttattctattttagttccaaaattaccaaatatagaaattagaactctattttagtttctatatttggcaatttatagactaaaatagaataaaatgaaaggactaaacattagtccctataaaccaaacactccctagattttag

SEQ ID NO: 5364 - DNA, 76 bp, Zea mays
cttgcgccacgagcagccaggctcccaaaaaacagaccctgatctcgttcctgtggagccaggctgagaggctaaa

SEQ ID NO: 5365 - DNA, 200 bp, Zea mays
acatattttttttcggtttttcctcgtcaaaatctcttgatttattgtcagaattggcatcgtgcttgtattttgacatgctatatagatggttttagtttgtagtcgcgtctgctaagataaggagcagagttgagtctggcatccaaattctgaagaagacagctaagttggcgagcgaagcggagacccgttgccgg

SEQ ID NO: 5366 - DNA, 100 bp, Zea mays
cagcagccgcaggagcagatgcagacgagggcgacgagcacgacgacgttgagcacggcgatcttgtgccagtcctggcgcacctgctccatgacgccgg

SEQ ID NO: 5367 - DNA, 151 bp, Zea mays
  unsure (147)..(148)..(149)..(150)..(151): n = A, C, G or T
tttaaattttagggtttgtttggttcgctgcctaacttgtcacactttgcctaacttttctgtctaaggttagttctccaatttgaacgactaaccttagacagagtgtggcatagttagccacaaaccaaacaggcccttagtaannnnn

SEQ ID NO: 5368 - DNA, 254 bp, Zea mays
cacgaacccggcgccgcccgtcacgagcacccgcagcgcgcgccgacgcagccccaggggaaccttcccgccgacggactcgcggaaggacgggtgcccgctgacggcaaggtggttgaagccgaccgacgcggcgggttcggacggagataaagtggagggggaagagaaggtgaagatagcggcagcgaagagcatgccggcgagggcgaagacggggcggtgctcggcggcggcgtagcgcgcggcgcggg

SEQ ID NO: 5369 - DNA, 126 bp, Zea mays
gggctgtttggtttgtagctaaatgtgcatcactttgtctaaggttagtcgttcgaattgaataactaaccttaggcacaaaagttaggcaaagtgtggcaagttaggcatcaaatcaaacaggcc

SEQ ID NO: 5370 - DNA, 239 bp, Zea mays
gtgctcctactccagtcggttggcggcgatgcacgggcaggcactgggcgacatgctgatggacagttggtcggcggcgatgcgcaggcagcagcatgcaggtgagcagcatgcaagtggagcggccgagctagctaggcatctagctgtgttcctgcgtgtagcgtgttgcaggcagcagcatgcgggttgtcgagcgagctagcatgcgggcgccgagcgacgacgagctggaagga

SEQ ID NO: 5371 - DNA, 216 bp, Zea mays
  unsure (92)..(93)..(94)..(95)..(96)..(97)..(98)..(99)..(100)..(101): n = A, C, G or T
cacttatcctggtgcaagcatgcaatcaagcgatctggtgcatccgatctagatctaatgatgactgttattttatatttaaccccttccannnnnnnnnnaccttacacctaaaacatagtacctattttaattttaaccacttccatatgaaaccgttggatctagattggatgctctggatagtttgattgcacgcttgcaccgaaatgagtg

SEQ ID NO: 5372 - DNA, 180 bp, Zea mays
cgcaggcgccgccgactgccgtggagagcgcgaggtagctgcgggcaggggcggagggcccattatggctcattatggcccaagccataccaaaaaaaaggtccgccggcccaacatctaaaccctaatcactgccgctccgagcgaccgcgcctccgcccgccgtccgccgccctaaca

SEQ ID NO: 5373 - DNA, 79 bp, Zea mays
tatagaatccgtagcaacgcacgggcacatgactagttctagtatatatatatgatctgtcgatgccacacaacgtaca

SEQ ID NO: 5374 - DNA, 164 bp, Zea mays
  unsure (71)..(72)..(73)..(74)..(75)..(76)..(77)..(78)..(79)..(80): n = A, C, G or T
cgacggcgaccaccagcggcgacgggaacctagggcggcggcacaaggatttttgcgatggatttcccctnnnnnnnnnntagggcggcggcacaactgcaggggcagcgccgcgcgcctccctttttgcgatggattctgttgttcgattggggattttggga

SEQ ID NO: 5375 - DNA, 125 bp, Zea mays
cacgagaaaatgaaactgccacatgatctgaccgtcggttctccatgaaagccaactctttcttcagatgggaatcaaagaacacgtatggtttcagatcatgctggcagcttcatcttcttgtg

SEQ ID NO: 5376 - DNA, 190 bp, Zea mays
gacttagggggtgtttggtttttagggactaatttttagtccctacattttattccactttagttacaaaattatcaaatatagaaactaaaactctattttagtttctatatttgtcaatttatatactaaaatggaccaaaatgaaggactaaacattagtccctagaaaccaaacacccccttaaca

SEQ ID NO: 5377 - DNA, 144 bp, Zea mays
gtttgcgatgtcatgctcttgtcactttcgatgtggctctttgttctctacttctggtttagatggtctggaactccccggtggaaaacctttccccctggttatgttttctttagctgatagttgcgtgagttttgtcggctt

SEQ ID NO: 5378 - DNA, 109 bp, Zea mays
gtgatgtgtgtctatcacaggcggttcttttaaaccggaccgcctgtgatgtgtgactatcacaggcggttcttttaaactggaccgcctgtgatgtgtgtctatcaca

SEQ ID NO: 5379 - DNA, 99 bp, Zea mays
aatgtcaaaaaaagacactcggcaaagaaactctctgtcgaggctcacaaatagaacactcggcaaagagctctttgccgagtgttttttctccaacac

SEQ ID NO: 5380 - DNA, 96 bp, Zea mays
tgttggagaaaaaacactcggcaaagagctctttgccgagtgttctatttgtgagcctcgacagagagtttctttgccgagtgtctttttttgaca

SEQ ID NO: 5381 - DNA, 104 bp, Zea mays
gaatgtcaaaaaaagacactcggcaaagaaactctctgtcgaggctcacaaatagaacactcggcaaagagctctttgccgagtgttttttctccaacactagg

SEQ ID NO: 5382 - DNA, 147 bp, Zea mays
tagagactagtcggttacccgtgcgttgcgatggctcacaataatacctatgtaaattatccaccaaaaagatctcaagattttttattggttgtctccactttttgcataatattttttattaatgcacgggtaccataggcagca

SEQ ID NO: 5383 - DNA, 194 bp, Zea mays
cgcgaaaacatcttaccggacggccgagccacagcgctgcgctgcgcagctccacgccgcttacggtaccccgcagatagcaccaactcgctcgctgaaagcatacgaggcaatggaagcaggctacaaaagaaggcgcagggcatcgttccaactcatacctttctcggccttttggctaagatcaagtgtag

SEQ ID NO: 5384 - DNA, 109 bp, Zea mays
tgacgcctgtcggctgacaaccgacgggaataagtcctaaaccgacgggaattacttattcccgtcggtttaaggcttattcccgtcggttcctggccgacgggaatta

SEQ ID NO: 5385 - DNA, 186 bp, Zea mays
ttacaagcgtgaaagcaaaccatctggtccattagatcgtgattcaaccgtatgtcacatttaacacttaaacccttccaccaccagctcaataatctttataaaaaaaactcctaacaaaccatggttgtatctgtggttggatcgtaatctaatggatcagatggtttgcttgtacgcttgcaa

SEQ ID NO: 5386 - DNA, 78 bp, Zea mays
tgaaaatattcttgcaggtagaagccatcctctccatggttaaattgaggacaacttctatccacaagatctaagaaa

SEQ ID NO: 5387 - DNA, 201 bp, Zea mays
gattaaaacaagtgactgctgtattgctgtccaaaaattctgcttgtgcttatttagtgttagttcacccttttggctaaaaatggttggttagcactaaattaatgtagacttgccatgactaagcttaataatgcacgtgtgtcatgttttgtatgtttcttgctgtagttgattgtgatataggagtctatcgacatt

SEQ ID NO: 5388 - DNA, 203 bp, Zea mays
ggcagggtcccactcgacagtccaacccggtggcagggtggtcggccaagttatcccagcaaccatctcctccagagaacctgtaaaaattatgccacaagcaaggctgagtatactaatactcagctagacttacccggtgtgaggagtctactcctctacctctagacaaccacctgtttggctgtggggtttgtttgcca

SEQ ID NO: 5389 - DNA, 198 bp, Zea mays
attatgttaagggggtgtttggtttctagggactaatgtttagtccttcattttggtccattttagtatataaattgacaaatatagaaactaaaatagagttttagtttctatatttgataattttgtaactaaagtggaataaaatgtagggactaaaaattagtccctaaaaaccaaacaccccctaagtctatg

SEQ ID NO: 5390 - DNA, 192 bp, Zea mays
agacttagggggtgtttggtttttagggactaatttttagtccctacattttattccactttagttacaaaattatcaaatatagaaactaaaactctattttagtttctatatttgtcaatttatatactaaaatggaccaaaatgaaggactaaacattagtccctagaaaccaaacacccccttaacat

SEQ ID NO: 5391 - DNA, 115 bp, Zea mays
tattttcggccagtttttttggcggccagaagccgccgaaattaaaccttttgccgccgaaaatagcttttttttcggtggcttctggccgccgaaaatgactgtagctgttgta

SEQ ID NO: 5392 - DNA, 132 bp, Zea mays
ggagctagtttgagagtccaaatatcggaggggattgaagggactaaaatctctttcttattcaaaattgtataaggagggtattttagccccttcaattccctccggttttgtggcttccaaactagacct

SEQ ID NO: 5393 - DNA, 237 bp, Zea mays
gcaaggagggcagacgagcagcgagcggtttgagaaggcagttagggttctcgcaaagcgtggaaagaaaaagttcaaaacgcgccgccccccgcccccttttatacacagggcattcaattctagacacacccaagtgatcaaatcctctccaaactccacacaacgccctagtgattagagagagagatttgcttgtgttctttcgagctcttgcgcttggattgctttcttctt

SEQ ID NO: 5394 - DNA, 83 bp, Zea mays
gattcatagccggattgcttctctaatttatataaactttgattaggttgaacgattccaggtgcaatccgacacaaacgaac

SEQ ID NO: 5395 - DNA, 144 bp, Zea mays
cacatatagggtctgtttggtttgatgcctaacttgtcacactttgcctaatttttctgcttaaggttagttcttcaattcgaacgcctaaccttaggcaaagtgtggcacatttagccacgaaccaaacagccccatagtata

SEQ ID NO: 5396 - DNA, 135 bp, Zea mays
actctttttgtgagggactgcaaacaacctgatttacagctgggctgcagcaatttttttccctagttacgtggaaaaaaaaattgctgcagcccagctgcaatcaggctgtttgcagccccacacaaaaaagag

SEQ ID NO: 5397 - DNA, 152 bp, Zea mays
ccctcgctcggcgcgcccttacggctcggggctagtgtgcacgcgttgaaatgaaacccgtgtcgtggactcgtggcccgcacaccaagtgagtgccactggacgcgttgaaatgatacggcgctggagcctggaggatcgtcgcgacaggc

SEQ ID NO: 5398 - DNA, 75 bp, Zea mays
gaacgcgacctgatcgacgtcctggggcttcgcccactaacggaaacccagggcttccattacctcttccctata

SEQ ID NO: 5399 - DNA, 179 bp, Zea mays
agtttagcccgggtcacatcaagcgtttaactttcaaataggagtatgaaatatagacccaaccaactgtactagattcgtctcactttttaatcttcggctgagaaattagttttataatccgactacatttaataccccgaacggagattcaaacattcgatgtgataggggctaaa

SEQ ID NO: 5400 - DNA, 130 bp, Zea mays
taggccctgttcggttgtttcggattggagccccggattaattcctagctggattacttctctaatttatatagattttgatgagctggaatgaatcctggctcattccggtacaaccgaacaggccctt

SEQ ID NO: 5401 - DNA, 101 bp, Zea mays
agctgtgatgcactatgtgtacaaacctaaaagatccacattgaaactctatgatttcatgtgtagttctcttaggtttctacacataatgtctcacaact

SEQ ID NO: 5402 - DNA, 110 bp, Zea mays
agtgggacgtgatattggcacggctcaatcagagagcagagccccaccccccctggcctctgctagggctcgagctctcgaattgaaccgcgtcaataccccgtctagct

SEQ ID NO: 5403 - DNA, 224 bp, Zea mays
tctgtctcttaggatgtgtttggttgcgggacaacttaggacagacaggacaggtacattcccttgtgtcatttctcgtacttccaatttagaggtacaattgagaacaacaatgaaatagttatgtcccaacacctgaccctgaatcaaataaacttatttaagggaccgtactatcccatcccatgttgttattataaccaaacacatccttagatatcaac

SEQ ID NO: 5404 - DNA, 103 bp, Zea mays
ttcgtggctaactgtgccacactttgcctaaggttagtcgtccgaattgaagaactaaccttaggcagaaaagttaggcaaagtgtggcaagttaggcagcaa

SEQ ID NO: 5405 - DNA, 178 bp, Zea mays
ttagcccctatcacatcgaatgtttgaacctccgttccgggtattaaatgtagtcggattataaaactaatttgtcagccgaagattaaaagacgagacgaatctagtccagttggctgggtctatatttcatactcctatttgaaagtcaaacgcttgatgtgacccgggctaaact

SEQ ID NO: 5406 - DNA, 155 bp, Zea mays
caatcaaactatccagagcatccaatctagatccaacggtttcatatggaagaggttaaaagtaaaataggtacttatgttttagatggaaggggttaaatataaaataacagtcattattagatctagatcggatgcaccagatcgcttgattg

SEQ ID NO: 5407 - DNA, 85 bp, Zea mays
cggctccgattcacttggtgcaaggcgggatccgtcccgtcggccgggcggcgggtcccgatctgcaccaagcgagcccgaggcg

SEQ ID NO: 5408 - DNA, 101 bp, Zea mays
agctgtaacgcactatgtgtacaaacctaagagatccacattgaaactctatgatttcatgtgtggttctcttaggtttctacacataatgtctcacaatt

SEQ ID NO: 5409 - DNA, 176 bp, Zea mays
ttctctctaaggtatgccttagaggggtgcttgacggggacaagggtatgcccttgaggtttcttgagccagcttctctctaaggtatgccttagagagaggtgcttgacggggacaagggtatacccttgaggttccttgagtcagtttctctctaaggtatgccttagagagag

SEQ ID NO: 5410 - DNA, 176 bp, Zea mays
gtttggttataatgacagaacgggatgagataggacgtaccttaaataaggttgtttagttcagaatcaggggttgagacaggattattccaatgttgtctctagttgcccctcgaaattagagtgacgagagagtacgcctggggacatctctatcctgcctgtcccgtaaccaa

SEQ ID NO: 5411 - DNA, 183 bp, Zea mays
cgacttttgttttttctacagtattttgtctatatggattacagttgcagtagttcgaacgatttttatctagtcacagtgaacaaccccccacatcctattcgcttcagattaaaaccagttgtcctgactgttgtaactacaatccatagaaacaaaataatgtagaagtagtagaagccg

SEQ ID NO: 5412 - DNA, 94 bp, Zea mays
gtggaattgtagtggattaagatgtattgagagagtatttgatctattagggatttgcaccctctccaatcccttcaaaacactccaattccaa

SEQ ID NO: 5413 - DNA, 78 bp, Zea mays
ttcttcttcgtatctctatatcgtcggatcttcttgaccttgcaagaccttttcttgaccttgtaagacccaactcta

SEQ ID NO: 5414 - DNA, 184 bp, Zea mays
agaattgtgaaggaatgaggctgtcatgcatgatctaacaacgatttgcaggcacaaagcgagacacagaccagacgagagcgcgcgaggccactctagtctagctgtgcgtggacgcctgctaatatggtgccaaccaaatcagagctagatcatgctggcagcttcactcattcgcaagagc

SEQ ID NO: 5415 - DNA, 174 bp, Zea mays
tgtgaaggaatgaggctgtcatgcatgatctaacaacgatttgcaggcacaaagcgagacacagaccagacgagagcgcgcgaggccactctagtctagctgtgcgtggacgcctgctaatatggtgccaaccaaatcagagctagatcatgctggcagcttcactcattcgca

SEQ ID NO: 5416 - DNA, 97 bp, Zea mays
aaccagagtcaatattagaggcagcgcatacaagttgtattagagagtatatgttttctataccagagtatcgtttccttttatatttattagcagg

SEQ ID NO: 5417 - DNA, 83 bp, Zea mays
atgctgcacgtgcgacggcaacagagctcgaggttctgcgcggcagtagagctggcagctctgcttctgtcgacgacaacacc

SEQ ID NO: 5418 - DNA, 83 bp, Zea mays
agtttgtggtttaccgagtctgttagattagactgcacttttttctgtaaaatctaatctagagagtggctaaatcagtaaat

SEQ ID NO: 5419 - DNA, 243 bp, Zea mays
ctgcatggtttccatgggctttcttgaaccatcaacaggtcgcgtgagcgagccggggggaagctcagcgatgcgattcgattcaattcaattcacggccggtcggggggaagagaattggtgggtgggactgggactgggactgggaggagccaatcattccgtcccacacacccagcaccagcaccaccaccaccacgcccacgagttcacagttcaagaaagcctgtggaaagcatgccc

SEQ ID NO: 5420 - DNA, 142 bp, Zea mays
gctccgaacctgttttgttggtggtcatttaaccatgcatgcttcgatcgatggattggtgcatgcatggattattgcatagtgtgatgcatgtggcgcatcagtgcatggttagatgaccatcagcaaacatgttcttgag

SEQ ID NO: 5421 - DNA, 77 bp, Zea mays
taagccgtcacatgccacacttttaagccacaagtgttcacacttgtggcttaaaagtgtggcgcggtgtggcggcg

SEQ ID NO: 5422 - DNA, 191 bp, Zea mays
ggatgttccagaatgctagggaatggtgttcttagtgcaggtaaatttgtcttattaaatgcctcatacttctgtttgtggcagtatgaaatcaattctagtagaacctttaacttcctgtgcactgttacatttacatagaaccgatagttaggattgagaatgttattgttaagcttcatttagtagaa

SEQ ID NO: 5423 - DNA, 194 bp, Zea mays
agacagagaggagctcccttcaatccaagcacgagggaaagatgatggcgggctcatctcccgggtcatgcacacccatgcaagtgcagaggtgagcagcggccattgctgcaccagagaggtatccatgaaccggcagctgcaaccgaccacttcccctcctggattggatcgaagggagctcttcgatcgcc

SEQ ID NO: 5424 - DNA, 234 bp, Zea mays
gcggccaccagcagatgaaactacagcatgacctggtcctggtgctcattaattaccctctctctctctcccttcccctctcatcttggattcgtcgatccatatatgacagtcagggacgggggagagagagagagtgacaggggccggtagtagtatagattacatccatcttacatataccaccaccatcataaccagatcatgctggcagcttcaccaactcgtggtgca

SEQ ID NO: 5425 - DNA, 186 bp, Zea mays
ggtaatgtttggttcacaaaatgtaacgtaaagggtaatggtttacactcgattactgtcggtaacaagtttgaatagtctgtatcaatttttagtacggtatctgattacggttaaactaaaacaaacatgaattaacgttatcacttacccattacgttacaattatgtgaaccaaacggtacc

SEQ ID NO: 5426 - DNA, 183 bp, Zea mays
gaggttacaagtgtcggtgatacaaatcttcgctcatcagggatgacaatttggtaataggattactatctaagttgtagcctttatatttttgctctcccaactgcgcttaggtttgtgccgcctgtgtcaatggatttatttgttttgtggatttgtgtggccgtcatccgtttcagatgt

SEQ ID NO: 5427 - DNA, 236 bp, Zea mays
agttttttaagattcatcacaggcttcaactacaacttggctagagaaattttaaaagaaggtatgtagctggtttgtttaatttatttatcctcccaaatatggttactgtccagacacaaagatgtgttttgtaggataaataaattaaggaaatctactatatatatataactttctttggaatttgtctcgcataagttatagttaagccgtgtgataaatcttatggaact

SEQ ID NO: 5428 - DNA, 109 bp, Zea mays
gagtggaaaattccaaagggattgcactgatcttgtcgtcgactcgcatcgcatgcagcaggcggcaggtgagaatagatcaatgcgatccctttggagtcctccacca

SEQ ID NO: 5429 - DNA, 142 bp, Zea mays
gaacaagatgtagccaaggacaacttgccggaagacaggcaccgcacggtatgggctcaaaattccaaacagattgcatatgctcccctgtaacatgcatgctcaaaatacccggcaagtcatccttggctgcatcccactc

SEQ ID NO: 5430 - DNA, 154 bp, Zea mays
agttcggctaggtgagatcctattaacagtagatccaaaaaataccgttcgattgcgtagaaggtaatcgaagcctgtcgcgtaggacagttcggctaggccggtgacctgccggcttgataaagagttgatgcagatctgatcccgcagcaac

SEQ ID NO: 5431 - DNA, 143 bp, Zea mays
acctgattcattagatcatgatccaaccgtaggtcacatttaacacttaaacccttccaccaccagctcaatattttttataaaaaaactcctaacaaactatggttgtatctgtgtttggatcgtaatctaatggaccagat

SEQ ID NO: 5432 - DNA, 108 bp, Zea mays
ttctctagccagcctggctctcatatggaaccaggctatagcctagctctcatatggaaccaggctatagcctggctctcatatggaaccaggctatatagagccgag

SEQ ID NO: 5433 - DNA, 173 bp, Zea mays
cattgctggcgccgatgtcatttttgacggtgttaatatatttcgttggagactgaaatatttgaatttacaatagggaatcttatgattggcttcccgagactccatcagaggggcaacggtgtattaattgtaagtaacatcttatgactggcaacggcttaccggagaag

SEQ ID NO: 5434 - DNA, 142 bp, Zea mays
gtgtctgctgatgcagcatcatcaagattctcatctcatcacatatgcatatagctgctgcgagacatcacagagcatgcatgcatcactgaagatgcgtgagagttggatgtgaatcttggtggtgctgcacctgcaagca

SEQ ID NO: 5435 - DNA, 72 bp, Zea mays
ggacggcgatttaatccgtagacggattcgtatatagacatgttttttgacctatggattagacggtatcta

SEQ ID NO: 5436 - DNA, 194 bp, Zea mays
gtgtaaacatgctaaaacgccttaacaacctttggatctagaatcaaagactaatcttaatcccacctaaccgccaccgcaccagattaccaggagggggttctttagaaaaaacacaagattatcaggtaggattaagattagcctttgattctggatccaaaggttgttaagacgttttaacatgtttacac

SEQ ID NO: 5437 - DNA, 130 bp, Zea mays
ctctgcaatttcccacagctttattgaactgccctcttgcttgcttggatcaattgaaactcgatcaggtccacagcacagcctgctgcatgcatgatgcagttcaagaaagctgtggaagatggcaggg

SEQ ID NO: 5438 - DNA, 116 bp, Zea mays
catcagattttatactcatcccttgtgtgccactgagtggcatataggtatattttttggtgtctatgacatgtggggccagtggcatacaaggaatgagtatatttttcagtggc

SEQ ID NO: 5439 - DNA, 145 bp, Zea mays
aaaatcaatccagaccacaccttccacatccaacggtgctgcgtcagggggttttataaaatgttctttgcaactctgtacattttacaaaaacccccctaacacagcaccgttggatgtggagggtgtgatctggattgatttt

SEQ ID NO: 5440 - DNA, 227 bp, Zea mays
catcctttaaacggtcctctaaatttagatgacgctgctagattctctatatataaagtttctctaaacaatcctctatctatttgaatactttaaataaccggtttaacaaaactaaaatatgtacaatatattgagagtgtgacaaatacgtatgtacaaaaaataaaaataaaaaatgtctctaatgttggtatttgagtatagaggacgtgatttagaggacg

SEQ ID NO: 5441 - DNA, 93 bp, Zea mays
gttctgtaccctaaatttagaggacgaggacgtcctctaccccctccagcaacgtcttctaaacggtcctctaaatttagagaacgctgcgga

SEQ ID NO: 5442 - DNA, 71 bp, Zea mays
gcagatggcttcggataaaaccacgcctaccgcctcagggattggagcaggtttcccccgaagagctgaag

SEQ ID NO: 5443 - DNA, 210 bp, Zea mays
tgcaatcatttatcctggtgcaagcatgcaatcaagcgatctggtgcatccgatctagatctaatgatgactgttattttatatttaaccccttccacctaaaacatagtacctattttatttttaaacccttccatatgaaaccgttagatctagataggatgctctggatagtttgattgcacgtttgcaccaaaatgagtgattgca

SEQ ID NO: 5444 - DNA, 203 bp, Zea mays
ggagctgatgatggccgtcttgcgctcatcagcgaaccccaggttgattcgcttggtttcttcagtcggccgcatagaggtcgcggcctgagcttcgtttgccggtacggcgaggtcttcctcaggcttagaattcgccagtgtcgaggaaaccgtcgatggcttggtgttgagggctgcttggatggccactcgaaaacatt

SEQ ID NO: 5445 - DNA, 83 bp, Zea mays
tgagagaagagtaacacctgaatttggttgataattagaaagaaattttataccccaaattcagggtgttacaactttatatt

SEQ ID NO: 5446 - DNA, 151 bp, Zea mays
cggagacatgggtagcttcgttaagctggcgaggagggcggtggagacggacgcgcctgtcatggtcaaggtgacgaatttctcccaccttgtcagaatcgcatcttggctctgagtttcttggtcttgtttggcgagttgttcctgatga

SEQ ID NO: 5447 - DNA, 230 bp, Zea mays
cttaacacgggtgatggttaggtcgcagcccatcagagtacgagtgactcgaggattgacaagtagtcataaaattatagtatctcagcaagaaccaagaagacagaaaaaagtcacttcccaaataatatacatagaggagctgtcatggtgctagaatataatgcatctcatctcatctcagtcacttccgaactctaggccttccgcctgccatcgcctgatcaggg

SEQ ID NO: 5448 - DNA, 205 bp, Zea mays
tggcatgctatgtcacttgcgtccccgaactctcaaaaccatgaaaacgggtacttaaacttgaccggcccatccgaatccaggtttggcccatccaaataccactgacgtgaatgctcaaactcgattttaaatgggtcggctaagttccagtacttgttttcctgattttaggagttcaggaaccaagtgacacatcatgcca

SEQ ID NO: 5449 - DNA, 246 bp, Zea mays
gttatgagtacgactgggcgtggacggtattcggtcctccggattttcaagggccgccgggggcgcaccggacaccgcgcgatgtgcggtgctcttccggccgctggaccctaccttcggctgaaccgattccagggttggcgggccgttaagcagaaaagataactcttcccgaggcccccgccggcgtctccggacttcctaacgtcgccgtctgccgccacgtcccggctcgggaaatcttaa

SEQ ID NO: 5450 - DNA, 103 bp, Zea mays
agaagcagttttatgcttcgttgtgtacgaaaagaagggaaggtatttttcaccttcggctcaaaaaatgctagtttcgtccacagcaaagcaattcaatgca

SEQ ID NO: 5451 - DNA, 115 bp, Zea mays
actaaaacttgagcatggcatcataagcattggcattgcatattgttgggggccttcggcttgccagaagcgcctcttctcagccatgatttaacaatgctatctggagtaaacg

SEQ ID NO: 5452 - DNA, 97 bp, Zea mays
caacactgtccaggcttcgttgtctttattcgtttcctcctcctgagcccctggcgtccaatcagcgataaagtctgccagcgcctgtgactgaatc

SEQ ID NO: 5453 - DNA, 86 bp, Zea mays
tttggacccttagctcggcaccatagcctgtggcgccgagctaacatagctcagcgccacagcctatggcgccgagctatgacgtg

SEQ ID NO: 5454 - DNA, 186 bp, Zea mays
gactaaggggtgtttgatttctagggatgtttagtcccatcattttattccattttagtctataaattgccaaatatagaaactaaaatagagttttagtttctatgtttggcaattttggaactaaaatggaataaaatgtagggacaaaaaattagtccctagaaaccaaacatcccctaatac

SEQ ID NO: 5455 - DNA, 187 bp, Zea mays
taaaatttagcccctatcacatcgaatgtttgaatctccgttcggggtattaaatgtagtcggattataaaactaatttctcagccgaagattaaaaagtgagacgaatctagtacagttggttgggtctatatttcatactcctatttgaaagttaaacgcttgatgtgacccgggctaaacttta

SEQ ID NO: 5456 - DNA, 209 bp, Zea mays
tttgccccagctaaaatttagcccctatcacatcgaatgtttgaatctccgttcggggtattaaatgtagtcggattataaaactaatttctcagccgaagattaaaaagtgagacgaatctagtacagttggttgggtctatatttcatactcctatttgaaagttaaacgcttgatgtgacccgggctaaactttagtccacagaac

SEQ ID NO: 5457 - DNA, 217 bp, Zea mays
gtttggttctgtggactaaagtttagcccgggtcacatcaagcgtttaactttcaaataggagtatgaaatatagacccaaccaactgtactagattcgtctcactttttaatcttcggctgagaaattagttttataatccgactacatttaataccccgaacggagattcaaacattcgatgtgataggggctaaattttagctggggcaaacca

SEQ ID NO: 5458 - DNA, 150 bp, Zea mays
tcgagctaacgagctggctcgagctcgtgtcgagctggctcgttaacgaaccgagctgagatgttagctcagctcgtgataaaattgaaacgagccgagtcgagccgagccgagctggccacgagtcgagcgagctcacgagctacgagt

SEQ ID NO: 5459 - DNA, 85 bp, Zea mays
ccgtgtcagtgctagatagcggaccaacagaatcctccacatatagcggatgcagtgatggtcctctattttagcgcacctttta

SEQ ID NO: 5460 - DNA, 140 bp, Zea mays
gtctaagggtctgtttagttcgttacctaacttgtcatactttgcctaacttttccgtctaaggttagttcttcaattcgaacgactaactttaggcaaagtatggcgcagttagccacgaaccaaacaggtcttaaatc

SEQ ID NO: 5461 - DNA, 116 bp, Zea mays
tttgcagccctcacaaaaatgaggatagactccacctgcaggtccaccagataacgttttagttgtgttattgatctgcgggtaggacctatccttatttttgtgaggggctataa

SEQ ID NO: 5462 - DNA, 96 bp, Zea mays
atatccacaggtatggatatggatactatataatatccacgggtaataatttcatgagtatgtatatcggctatccatatccgtcacccaatggac

SEQ ID NO: 5463 - DNA, 134 bp, Zea mays
ggttatatatccgagctcggcgccatagatcttggcgccgagctcggtgccacgttggtgccacggcgtccgggttatgccagcgcagcacgtacctcggcgccatagcttatggcgccgagctgtcgagcaaa

SEQ ID NO: 5464 - DNA, 113 bp, Zea mays
gagctcggcgccatagatcttggcgccgagctcggtgccacgttggtgccacggcgtccgggttatgccagcgcagcacgtacctcggcgccatagcttatggcgccgagctg

SEQ ID NO: 5465 - DNA, 84 bp, Zea mays
gtctggttttgggtcaagtagactcggtctttgagcacacgtcatgctgcaactcgaggacgagctgcttatccaggaggggtg

SEQ ID NO: 5466 - DNA, 140 bp, Zea mays
aatattttcttagggctagtttgggagctcaattttcctaagggattcttattttcccaagggaaaatgaactaatttcccttaggaaaatgaaaatcccttgggataatgtggttaccaaactagcccttaaacattct

SEQ ID NO: 5467 - DNA, 71 bp, Zea mays
ccgagtgtctgaagcactcggcaaagctagaaaaacgctcggcgaagactttatcgagtgtgacactcggc

SEQ ID NO: 5468 - DNA, 213 bp, Zea mays
tcgttattttaagggtgcgtttggttgcaatgacaggacgggatgggacgggacgatccctcaaataaggttgtttggtttaggatcagggattgggacagacctatctcagtgttgtccccaattatccctcaaaattggagggacgagagaggacggcagggacgcccctgtcctggctgtcccgcaaccaaacacaccctaggtttatac

SEQ ID NO: 5469 - DNA, 226 bp, Zea mays
tcgaccagcacctggtggaaccgtcgtcgtcccgctaagtcaccattgtcgaccaacacttggtggaaccgtcgtcgtcctgctaacctcgacccaaaccccagctaccgaccggctcggtgggcggcaactcatgttctactcatggcgatggcgaagacaacagcaggctcgggctctatgtcgcgacttgtgcgactgctgcggtgcgccagggcggggttgc

SEQ ID NO: 5470 - DNA, 185 bp, Zea mays
ttacaagggtgcaagcaaactatctggtccattagattacgatccaaccacagatacaaccatggtttgttaggggcttttttataaagattattgagctgatggtggaagggtttaagtgttaaatatgacctacggttggatcacgatctaatggatcagatggtttgcttgcacccttgcaa

SEQ ID NO: 5471 - DNA, 250 bp, Zea mays
gtatgagcttagcttggcccatgcgagatgatgtttggttgcttgtataaatgcttgatgcatgagcttaaaaactataaagttttattatattttcatgtgatgatgttgcaatagtctataatatgccatacaaagcttaatccacttttaaataatttaactttatttaatagacactaattacatgttaatctgtcattaggaaagactaatggttgcaccggcagagcctggctctggagaaacg

SEQ ID NO: 5472 - DNA, 201 bp, Zea mays
cctctctgggtgcgtttggttgcaatgacagaacgagatgagatagaatgatcgcttaaattaggttgtttagttctgggtaagagttgagacaaaactatcccaatgttgtcctctgttgtccctcaatattggaggggtgagagaggacgccaggggatgtctctgtcctagctgtcccgcaaccaaacatatcatagc

SEQ ID NO: 5473 - DNA, 99 bp, Zea mays
gggtttcattagctgccgactcatccattcacctgccaagaaccatggacaggtctggtcttggtagccgagtgggtggcgcgggagctaaaatcaagc

SEQ ID NO: 5474 - DNA, 129 bp, Zea mays
taatacggagatcagaaagaggccagaggcccaaccctatatcattgtctcgtgtgtttcctatatcgtgcttaagggaagggagacgggttctctgcagcttcttgcgcctctactgagggaaggggg

SEQ ID NO: 5475 - DNA, 209 bp, Zea mays
gtaacaagttgcccgtctagctcagtcggtagagcgcaaggctcttaaccttgtggtcgtgggttcgagccccacggtgggcgatgttatttttttggcggtctgcctcggctgtgtgggtctggtaggctcatttttttgacgtctgggtcgactgtgcgtggcccaattgttattctgcggtctgggcctagtgggctcattctttt

SEQ ID NO: 5476 - DNA, 115 bp, Zea mays
attcgatgcgtgctgtttctctgcaggacaacaatatgaagacagcaactacaactctccaacaataaggtatgttttcctattcctcttagtagaagagatgtactcgtcataa

SEQ ID NO: 5477 - DNA, 116 bp, Zea mays
gccttattttgtctgagcgaagccgtcgccgtgtaagtgaaaccctaaccctaacgctctctcactccctcgtcctctcctctccgtgcggcggctcccagatccggctctcggtc

SEQ ID NO: 5478 - DNA, 82 bp, Zea mays
ccagcacagcggcactatcaagcaggcacggattagctgtcgtatttaatcgtgtcgtgcctgatccatgtcgcgtttgatc

SEQ ID NO: 5479 - DNA, 195 bp, Zea mays
cgcaggaggtccatggcccagactatgatccgagcaccgagccgatcgaccctgatgtgctcatgagggtcgaaggaggcaagagacatgggcggtactggattgccgacggggcaatcgactcgtcctccactcccactgtctcaggtgagagcaaggagcacgggctcgagtccagccatacgacctcggcac

SEQ ID NO: 5480 - DNA, 205 bp, Zea mays
ttttaactagctgaatgcccgtgtgttgcaacgagaatatataataccagtatactacgataacttatatacaaaatgtgtgttataccgttatgagaaaatgtttcataatcaatttgtgattctggtcatacataatttttgttatttataatctatcggtttcaccactatattgcaaccatcagtatcatgcagacttcga

SEQ ID NO: 5481 - DNA, 87 bp, Zea mays
gcaaagggttctttgccgagtgttttttgtcggacattggcaaagactttgacgagtgctaaaaaacactcggcaaaatcaaaatcg

SEQ ID NO: 5482 - DNA, 159 bp, Zea mays
attaaatccacttaaggtcttgttcgtttgtgctggattgatgggtcggattagtttcttaaccggattgcttctctaatttatataaactttgattaactggaacgattccgggtgcaatccgacgtaaacgaacaaggcctaaggctttatttcggt

SEQ ID NO: 5483 - DNA, 154 bp, Zea mays
aaataaagccttaggccttgttcgtttacgtcggattgcacccggaatcgttccagttaatcaaagtttatataaattagagaagcaatccggttaagaaactaatccgacccatcaatccagcacaaacgaacaagaccttaagtggatttaa

SEQ ID NO: 5484 - DNA, 102 bp, Zea mays
ggacgtgatattggcacggctcaatcagagagcagagccccaccccccctggcctctgctagggctcgagctctcgaattgaaccgcgtcaataccccgtct

SEQ ID NO: 5485 - DNA, 97 bp, Zea mays
tgccggattagtgggtcgggacgattcttagctggattgcttctctaatttatataaactttgattagctggaacgattccgtgtgcaatccgacgt

SEQ ID NO: 5486 - DNA, 173 bp, Zea mays
tagcccttatcacatcgaatgtttgaacctccgttcggggtattaaatgtagtcgaattataaaactaatttctcagccgaagattaaaaagtgagacgaatctagtacagttggttgggtctatatttcatactcatatttgaaagtcaaacgcttgatgtgatccgggcta

SEQ ID NO: 5487 - DNA, 254 bp, Zea mays
gttaaatttcgcaatttgggagtgaagttttttcacaaatttgaaaaagaatactgcattattttcaaatactgcagcatctgtatacagcatgctagttaaaatatcggttttaaaaattaaagtattgtaaatattgtagttgttttaaggtatggtttagaatactatggtatttttaaactgtggtattgtcatgagtaaagtatactgtagtatttcaaaaactttgttcccaaacagtgtctaagaga

SEQ ID NO: 5488 - DNA, 149 bp, Zea mays
atggctgcttaaggccttgttcgtttgggtcggattacacccggaatcgttccagctaatcaaagtttatataaattagagaagaaatccggttaggaatcgttccgacccagcaatccagcacaaacgaacaaggtctaaaggggatc

SEQ ID NO: 5489 - DNA, 197 bp, Zea mays
agcaaacatgtctctctgttgggccctgacgctatcaagggtgctgtgaacggtggtgactgccagaaagaaggaaacggtgctgagccagatagtacagcctcagaacccgaggggatcaaagacgttgaggatgagccctcaaacaaacgccaaaaaaccagcgacggcgaaccagcaagcgaaccttgatttgt

SEQ ID NO: 5490 - DNA, 81 bp, Zea mays
tcacaagcggtttttgtttaggaccgcatgtggttctctatcattttcacaagcggaccctaagacaaaaaccgcctgtga

SEQ ID NO: 5491 - DNA, 185 bp, Zea mays
aaaatttagcccctatcacatcgaatgtttgaacctccgttcggagtattaaatgtagtcggattataaaactaatttctcagccgaagattaaaaagtgagacgaatctagtacagttggttgggtctatatttcatactcctatttgaaaatcaaacgcttgatgtgacccgggctaaacgct

SEQ ID NO: 5492 - DNA, 149 bp, Zea mays
aggaattcataaggccttgttcgtttgtgccggattagtgggtcgaaacgattcctaaccgaattgcttctctaatttatataaactttgattagctggaacgattccgggtgcaatccgacataaacgaacaaggcctaagtcggaac

SEQ ID NO: 5493 - DNA, 68 bp, Zea mays
gtgccacacattgcctaaggttagtcgtttgaattgaataactaaccttaggcagaaaagttaggcaa

SEQ ID NO: 5494 - DNA, 249 bp, Zea mays
  unsure (128): n = A, C, G or T
gacattatcagcgtgattggttgactgggtgcgcagcgccagtctccggctagcccggaccgcgggatacgcaggatatgcgcgtttccgcgcatgcaggcaatcaagccaaaaaaaagtctatgctncatgtgcgtgtacaggctgccaccctcctttccggttaaccaaacagaagctgcgcaaggtcaacgggacgccgtgggtctggatgcagccggccaaccaaccaatcacgtagtatgtctt

SEQ ID NO: 5495 - DNA, 143 bp, Zea mays
atccttagttttggcacagacctcattgctatccttagttttcaaacgacctcaatcatacctgttggaacttgctttcaagcgcaaggaggccaacaagggtgaacagtgatgacaacagggttccgtgctaggaggcaata

SEQ ID NO: 5496 - DNA, 172 bp, Zea mays
acgggaggacccagggcgccgccgtcggcgacatgacccagcgccttctcctcgccctctcgctcatcgcatcagcgaccgccgtgcccgctgtcatccgcacggtcccggacgaccccaccgcgggctcctctggcgcggcagacgccgcggacgcgctcttctgtgacag

SEQ ID NO: 5497 - DNA, 127 bp, Zea mays
ccatcttcccagtcaaccgttccaccgccagcatcatccgctcccagcgctcctcccctttttgctcggtccccgccattgcttccaggatcagccgcgtctgaacggatggcttcgtggaaggcgc

SEQ ID NO: 5498 - DNA, 82 bp, Zea mays
ggcacggcacggcccataattagatatgtgcttttgtgggccgtacctttgtgggccgtgcttttgtgggcctgtgccgtgc

SEQ ID NO: 5499 - DNA, 224 bp, Zea mays
atctgtctcttaggatgtgtttggttgcgggacaacttaggacagacaggacaggtacattcccttgtgtcatttctcgtacttccaatttagaggtacaattgagaacaacaatgaaatagttatgtcccaacacctgaccctgaatcaaataaacttatttaagggaccgtactatcccatcccatgttgttattataaccaaacacatccttagatatcaa

SEQ ID NO: 5500 - DNA, 84 bp, Zea mays
agtgtcaaggccatagcactcggcaaaagaaggaacatttgggcaccgataaagcctctttgtcgagtgctacgaccctgacac

SEQ ID NO: 5501 - DNA, 71 bp, Zea mays
tgcctaactttttctgcctaaggttagtcgttcgaattgaataactaaccttaggcaaaaaaagttagaca

SEQ ID NO: 5502 - DNA, 168 bp, Zea mays
gacggcgatagagactttgccgagtgtgcccgtgacacttggcgaaggcttactctttgccgaatgtctactgtcacagcactcggcaaagaagctccccgtcgacacctttgtcaatacctgtgctgagtgtattaggaggcactcggtaaaggttctatctttgcc

SEQ ID NO: 5503 - DNA, 209 bp, Zea mays
gttacaatccgacacaaacgaacaaggcatcaatctcacccaatacacatggattaacggtaaaacgaacaacttggaaatgattttttttttcatctccatatggtgacaatgttggactcgattgaaaggtcgcactattcgtttcgctatttcctgtgataaatcaaatgttttcctcattggctttgctgtttgtcaccaacaaa

SEQ ID NO: 5504 - DNA, 98 bp, Zea mays
tcggtaaaagaaaacactcggcaaagaagctctttgccgagtgtcaaaaatataacactcgacaaagagcttctttgccgagtgctttttttttcaac

SEQ ID NO: 5505 - DNA, 99 bp, Zea mays
gttgaaaaaaaaagcactcggcaaagaagctctttgtcgagtgttatatttttgacactcggcaaagagcttctttgccgagtgttttcttttaccgag

SEQ ID NO: 5506 - DNA, 99 bp, Zea mays
tgttgaaaaaaaaagcactcggcaaagaagctctttgtcgagtgttatatttttgacactcggcaaagagcttctttgccgagtgttttcttttaccga

SEQ ID NO: 5507 - DNA, 177 bp, Zea mays
tatcttttttgtttccgttccatagctatctggattcagtttttgttttattttatgaatgcagccaatgaccagtgctacagaaggcaacttcttgtgctctctagcataatggttaaggcttccgagtagcacctccagaggccgtagagatggcaatggggacccgatccctga

SEQ ID NO: 5508 - DNA, 140 bp, Zea mays
gattaagggtatgtttagtttcctggctaacttgtcacactttgtctaacttttctgtctaaagttagttcttcaatttaaacgactaaccttaggcaaagtttgacgtagttagccacgaaccaaacatgctataaatc

SEQ ID NO: 5509 - DNA, 158 bp, Zea mays
agtatgatcttgttaaggccttgttcgtttccgtcggattgcaaccggaatcgtttcagctaatcaaagtttatataaattagagaagcaatccggtcaggaatcattccgacccaccaatccggcagaaacgaacaaggcctaaacgattaccgatt

SEQ ID NO: 5510 - DNA, 148 bp, Zea mays
gtaatcgtttaggccttgttcgtttctgccggattggtgggtcggaatgattcctgaccggattgcttctctaatttatataaactttgattagctgaaacgattccggttgcaatccgacggaaacgaacaaggccttaacaagatc

SEQ ID NO: 5511 - DNA, 255 bp, Zea mays
  unsure (164)..(165)..(166)..(167)..(168)..(169)..(170)..(171)..(172)..(173): n = A, C, G or T
tagctggcgcatccaggaggcctcggccacgccgttggccacaacgcggtactcgacctctgcactggagcgggagacgacgggctgccacttggcggcccaggagacaaggttggcgccctggaacacgacatagcccgaagtgcaccggcacggtcggcccnnnnnnnnnnaagaactcatcgcgccagccgggtgtagctgttgttggcgaggtcgaggacgacgtgaacgagactccggatgttttgcaca

SEQ ID NO: 5512 - DNA, 89 bp, Zea mays
ggtatatgcctgtgcgttgcaacggagacatataatacataagttaccgtgatattatatgtccccgttgcaacgcatgtgcactcacc

SEQ ID NO: 5513 - DNA, 132 bp, Zea mays
attattagggctgatttggtgacccgggattctgggaggatcggagggaattgaggaggaaattagtttatttccccctcaatcccctccaatcctctcaggatctccttgtcaccaaatcaacccttaaag

SEQ ID NO: 5514 - DNA, 182 bp, Zea mays
aatttgctgcagcccggcagcaaaccaggatctttacagcccctcacaaaaaagaggatagacctcatgcgcaggtcaataacacaactaaaacgttacctggtggacctgcaggtggggtctatcctcctttttgtgagggactgcaaacctcctggtttgcagccgggctgcaataaagt

SEQ ID NO: 5515 - DNA, 126 bp, Zea mays
ggccgatttggttcgtgattaaatgtgtcacactttacttaaggttagtcgtccgaactgaataactaattttagactgaaaagttagacaaagtgtggcaagttagacagtgaaccaaacatgct

SEQ ID NO: 5516 - DNA, 117 bp, Zea mays
atactaggctgttaggaggggacgggggaggtcaaacccaacgtacatcatgagtggagctgctgtaatgtaacagaagtattgcaccccccccccccccccccaataatatataac

SEQ ID NO: 5517 - DNA, 153 bp, Zea mays
cccactcgcttagggctagtttgggagtcataaaatcggatggaattagaggggccagaatcccctttttatttagattttaataaaaagaggattttgtactctctaatcctctccgattttgtgtcttccaaactggctcttagagttgtg

SEQ ID NO: 5518 - DNA, 196 bp, Zea mays
aaaatcataagaactctcttgtaacgaccgagaatcccaccgtagtaataaatttagagcacagataacacatgttatgataatttaaccttgctattttaacaggaattagccttgcaaccttcaaggctatgtctaagccatatattatactaggtgtatgcccgtgcgttgctacggagtcaacatgtattgt

SEQ ID NO: 5519 - DNA, 201 bp, Zea mays
atcactcatttggtgcaagcgtgcaaccaaaccatcccagagcattcaatctagatccaacgatttcatatgaaaggggttaaaagtaaaataggtactatgtttcaggtggaaggggttaaatgtaaaataacagtcatcattagatctagattagatgcaccaaatcgtttgattgcacgtttgcaccaatataaatga

SEQ ID NO: 5520 - DNA, 190 bp, Zea mays
agttagtgggtgtttggtttatagggactaaacattagtccctccactttattctattttagtttataaattgttaaataaggaaactaaaatagagttttagtttctatatttagtaaattagggactaaaatggaataaaattgagggactaaaaattagtccctagaaaccaaacaaccccttagtt

SEQ ID NO: 5521 - DNA, 150 bp, Zea mays
tacaagcataaggccttgttcgtttacatcggattgcacccggaatcattccggctaatcaaagtttatataaattaaagaagcaatccggctcggattcgttccgacccatcaatccgacacaaacgaacaaggcctaaggatgctttg

SEQ ID NO: 5522 - DNA, 148 bp, Zea mays
aagcatccttaggccttgttcgtttgtgtcggattgatgggtcggaacgaatccgagccggattgcttctttaatttatataaactttgattagccggaatgattccgggtgcaatccgatgtaaacgaacaaggccttatgcttgta

SEQ ID NO: 5523 - DNA, 205 bp, Zea mays
tcaccgtgcccagactttcaacgtgtgttgaccgcgtccaatcctgttattggtttcctgcatcgtcatccgcaagtctggatgagcgcatgcaactttagttcttttacccgttgggtcttgcatgtgtggagaagcatgtgagggtcttcactagcgatgtaggcttgcgcgaggccggcacacgtggacgcggcaaccaatc

SEQ ID NO: 5524 - DNA, 87 bp, Zea mays
cgcctcgggctcgcttggtgcagatcgggacccgccgcccggccgacgggacggatcccgccttgcaccaagtgaatcggagccggc

SEQ ID NO: 5525 - DNA, 92 bp, Zea mays
cgccggctccgattcacttggtgcaaggcgggatccgtcccgtcggccgggcggcgggtcccgatctgcaccaagcgagcccgaggcggcgc

SEQ ID NO: 5526 - DNA, 110 bp, Zea mays
tggttggtggctaaatctgccacactttgcctaaggttagtccttcgaattgaaaaactaaccttagacagaaaagttaggcaaagtgtggcaagttagacaccaaacca

SEQ ID NO: 5527 - DNA, 235 bp, Zea mays
cgtggaccctagctcggcgccgcaggtcatggcaccgaactcgcaagaatacaatagcaaccatttaaagtttaacgtcgttctattctgtttcaggtcttaacaataggtatcaacaaaataataatatgttttctcttttctaatggctactatctcaccttcctaattgagcaagataaatcttttgtggtggacgaaaaccaagatctatggcgccgagctcgtaaaaata

SEQ ID NO: 5528 - DNA, 150 bp, Zea mays
tagatatccctgaggccttgttcgtttgtgccggattggtgggttggaacgaattctaaccggattgtttctctaatttatataaactttgattagcgggaataattccgggtgcaattcgacacaaacgaacaaggtctgaccttagta

SEQ ID NO: 5529 - DNA, 123 bp, Zea mays
acggtgactgagcctttgccgagtgtcaggccagcagacactcgataaagggagctccagtgggcccccacgccaatttctgcgtcgagtatgcggcctagcactcggcaaagaaggagcctt

SEQ ID NO: 5530 - DNA, 100 bp, Zea mays
ggatgctggccagcatgcggtcgtgcacgctagaactatttttcactgcccgcctgcacgtgtggagatggcgctgatgaccgtcgctgaggagccaggc

SEQ ID NO: 5531 - DNA, 214 bp, Zea mays
aatattgtctaagggtgcgtttggttgtaatgacaggacgggatgggacgggacgatccctcaaataaggttgtttggttcagggtcaggggttggaacagacctatcctagtgttgtccttagttatccctcaaaattggagagacgagagaggacgccaggggacgtccctgtcctgactgtcccgcaaccaaacacaccctaaattgacca

SEQ ID NO: 5532 - DNA, 105 bp, Zea mays
tgtttgggaaaaactttggttgagaccaatcagccagagcgggacctagctggcgctctctttacagagaaaaactttggttgagaccaaagtttccaaaactgc

SEQ ID NO: 5533 - DNA, 204 bp, Zea mays
acataacacttagggctagtttgggagcaaaggaattgagggggtatgaagggaattttagccccccccccccaccgtgaccatggaattggagaggatccatggggaggaaatccctcatggatcccctcgaattccctggtgaccaaatcagccttgatcccctccaattctcttgctctcaaactagcccttatgggtcca

SEQ ID NO: 5534 - DNA, 85 bp, Zea mays
cccagatgccacagcctaaggttaggcatgccccatttttgtcggtaagtgtttggttcatgcctaatattaggcagccacgaaa

SEQ ID NO: 5535 - DNA, 136 bp, Zea mays
ttaagggcatgtttggtttgtggctaattatgcctcactttgtctaaggttagtcgtttaaattgaataactaatcttaggcaaaaaagttaggcaaagtgtggcaaattagatagcaaaccaaacaggccctaaa

SEQ ID NO: 5536 - DNA, 112 bp, Zea mays
ctgcttcggtagccaaggatgagctgcctgtggcctcctgctgcggacgttgcgtggccccgcctccaccgcgtgcggtccccgcaggcagcctccttggctagtctgagcg

SEQ ID NO: 5537 - DNA, 137 bp, Zea mays
agtctgtccagatagccaaggatgacttgcctgtggcttcttggcttggcttggctcgggcaaaaccttgtgcacgttttattgctcgcctcgtggcctcgatcacaggcagtctccttggctagtccgggcgggcc

SEQ ID NO: 5538 - DNA, 75 bp, Zea mays
gccacacgcgtgctcgctcgtgtttcgcattatttatcgcgtgacttgtgacttgcgacgatgcgcgatcgtgac

SEQ ID NO: 5539 - DNA, 215 bp, Zea mays
tagtgtatcccctactttttcatctcccgcagtggtttcccctaaatactccccctatatcccactacaatataaaatatcattttctatacctacttttcatctactatcaatttttcttctactattaattgaaggcgggcccacaggaacagtggtagggggagagcgcgcgtgcgctgcagctgaggggagagagaagagtcccgcgcggt

SEQ ID NO: 5540 - DNA, 148 bp, Zea mays
gatgtatttcgggcatgtttggtttgatgactaagtcgccatattttgtctaacttttctgcccaagattagttcttcaattcagacgactaaccttaggcaaagtgtgacacggttagccacgaaccaaacaagcccttcatgtcca

SEQ ID NO: 5541 - DNA, 137 bp, Zea mays
gcgattgagggctgatttggtgaccagagaatcgaagggatccataggagaggaatcctcttgctattcaaaccaaggaaatctcttgctattcaattcacttgaattccctgctcatcaaactagcccttactact

SEQ ID NO: 5542 - DNA, 142 bp, Zea mays
gacatcgatctcatctaaaagtttcttctcaatacataaagtggccaagccattcagtcgttcttgtgacattgtagaccttaaataattctttaataattttaatttcgagaagctcctttcagctgatgccaccgtaaca

SEQ ID NO: 5543 - DNA, 158 bp, Zea mays
ctaatctaaacagctccacaccctcctggacaaaagagcggcagcacacggattgcaagcgactcaaatcaaagctgaccaactaacgtcacctctccgcctccgcgtatcaagaccccggatcgtttaggatgtgtttggttgcctgatccagcctg

SEQ ID NO: 5544 - DNA, 93 bp, Zea mays
taaaaaaggaggattgaccctacctgcaggtccaatagataacgttttagttatgttattgctgctgtagataggctcaattttttttatgtg

SEQ ID NO: 5545 - DNA, 86 bp, Zea mays
cgggcgggtgggtggcctaccctcaccaagaccaaccacgtcgagtgggccgtgggtgatgagggtacggctccaggttcgccaca

SEQ ID NO: 5546 - DNA, 228 bp, Zea mays
gtttagcggtacaagtaaggccgcaacggtatcctgtaacacctcctgtacattttcaggctagagacctctcctccaaatgtgcaggcgttgtctcgtcctccaaatcatctcaaggtggccgcatccatatcccgagcgacgacggccgatcttcctcgtgcatgtgttcccaagcgacgacggacgatgtacttgccgcagcagccatggttcgtcgaccgttga

SEQ ID NO: 5547 - DNA, 138 bp, Zea mays
tctagtttgggagtccaaataccggagaggatcggagatgattgaaggactaaaattcatccttattaaataaaagtaaagaaatgaggggatttgagcccctccaatccccttcgattttgtggctcccaaactaac

SEQ ID NO: 5548 - DNA, 76 bp, Zea mays
tgccgttgcaacgcacgggcactcacctaccttatataatacactaggtgagtgaccgtgcgtcataggcccgagt

SEQ ID NO: 5549 - DNA, 98 bp, Zea mays
tcgtctgtcccacgccaaagcacaggtctaagactcagcccggtcgtggtcgttctcacatgggcttcgatgccgctgtgtatgggtggggtaggggt

SEQ ID NO: 5550 - DNA, 134 bp, Zea mays
tccttaaggactgatttggtgacccgggatcccgagaagaagaaatcctcttgctattcaaaattgaactacaagggaatttctcccccatggttccccttgggatccctaatcaccaaatcagccctaaggta

SEQ ID NO: 5551 - DNA, 164 bp, Zea mays
atactttttaggggttaggttgggctggagaagtccgggggcttttatgaaaaagtccttcgcagggagaccagaccattgttttgggacgcacattggaacacggggcatttacctcatatttaggctattttcgtctaacctcaatctcattcattactagg

SEQ ID NO: 5552 - DNA, 112 bp, Zea mays
tggttcgtggctataactgtgccacactttgcctaaggttagtcgtccgaattgaaaaactaaccttaggcacaaaaattaggcaaagtgtggcaagttaggcagcgaacca

SEQ ID NO: 5553 - DNA, 124 bp, Zea mays
ttactcgatcgcgcttggaatcgcacggggcctggcttatctgcacgagggttgcgttgatggtatcgtgcactgcgaatgcgatataaagccagactagtcggttgtccgtgcgttgcgacgg

SEQ ID NO: 5554 - DNA, 75 bp, Zea mays
agtgaggagcgagaagacgacggagtcgctcatttgtagggatgctgtgctctgtttgttttcttatctgcttaa

SEQ ID NO: 5555 - DNA, 73 bp, Zea mays
ctgctttgtctcgcgagctaaacgagccgagctagactaactctgtggctcattagctaaagggatttccctt

SEQ ID NO: 5556 - DNA, 193 bp, Zea mays
acgagtcgtgcgctaatcgtgtcgtgccagggccgtgtcggaccgggccgctcgtttggacatatatacttgcagctatagttgaccaaacgaacagcccaacatgactcggcataggcccgttagcctgacagctaatcgagtcgtacccgatcggcccacgtgccacagacgcggtctaggcatgatatgt

SEQ ID NO: 5557 - DNA, 141 bp, Zea mays
gtaaatggttctgtccgctaaatctaggggtcagcgacctcctgcatcctgctccgatgaccgcggacggcctgaggctgtctccagcaacgaaccctaaatggtcctgtactctaaatttagaggatgagacgtccacta

SEQ ID NO: 5558 - DNA, 122 bp, Zea mays
tgaggggaatgaagcctggtccgagatcttgtagatctgaggaacaaaaaaaactacacatgcaagcatggatcatcctcaaatcggaaagcaagaccttgaaccagacaacattccactca

SEQ ID NO: 5559 - DNA, 143 bp, Zea mays
ggtagacgattagggctagtttgggagttagaaaaccggagggaattggaggggctaaattccccttgttatttaattttgaatgagaagggaaatttagtcgctctgattttgtggctcccaaactaactcttagcttttgc

SEQ ID NO: 5560 - DNA, 106 bp, Zea mays
aggtcagaaagtatagtccgcctatttccttttcctatatatatatatattattctttaaagccggttagaaacggagatgctagggctatccacgtcgacagaaa

SEQ ID NO: 5561 - DNA, 138 bp, Zea mays
aacgggacgtaatttcggatacggatacgggtattttgtttgtcgggacggatacgggtattacccggatattgaacctcggatacgggtaggatacggaatcactaatacccggtcagtacccgaaaatcccggatc

SEQ ID NO: 5562 - DNA, 226 bp, Zea mays
tagaacggtagaatggacggctgagatcgcagaatggcagaacaccaaaaaaggcagggctactatagctaaacttaataagtagtaggagatatataatttttcagacaaatacccaatgcacataatcttgtttcagggtgtctcaaatgagaacaaaaaactgaaaagggatttggtgaaggactgttttgtacttttgtttctcaacttccaaagagctttg

SEQ ID NO: 5563 - DNA, 136 bp, Zea mays
atagacttttaggccttgttcgtttgtgccgaattggtaggtcggaacaattcacttctctaatttatataaactttgactagctgaaacgattccgggtacaatccgacataaacgaacaaggccttactgggtg

SEQ ID NO: 5564 - DNA, 134 bp, Zea mays
ggtcaaattaacttgctagaggccaactggatcgtacctaggggctacagtaagccgtaggaagttagtcagctggcggcgtgaacctactaacttccgagaggcaccgttgggcgctggctgtaggaagttag

SEQ ID NO: 5565 - DNA, 115 bp, Zea mays
ttagattaaagctgtttggactgctgctagagactgattaaagtcaagcggagcgaaacgtttctgcctggcatgcatggtctccggcagtgctatcaatgcagcctcctgaatc

SEQ ID NO: 5566 - DNA, 126 bp, Zea mays
ggcctgtttggttcgtggctaactacgccacactttgactaaggttagtcgtttaaattgaagaactaaccttaggcagaaaagttagacaaagtgtgacaagttaggcagggaaccaaacatgcc

SEQ ID NO: 5567 - DNA, 148 bp, Zea mays
tttgtcgataaggccttgttcgtttctgtcggattgatgggtcggaacgattcctaaccggattgtttctctaatttatataaactttgattagttggaacgattccgggtgcaatccgacacaaacgaacaagccctaaatgaaatc

SEQ ID NO: 5568 - DNA, 215 bp, Zea mays
ggtcttaggatgcgtttggttgcaatgatagaacatgataggatagaattatttctcaaataaggttgtttgattcagaattaaggattggaatatgattatcacagtgttgtctccagttgtccctcaaaattggagggacaaaagaggatgttagaggacgtctctatcctggttgtccctagttgtcccgcaaccaaacacacctagtgttt

SEQ ID NO: 5569 - DNA, 176 bp, Zea mays
ttttactaggttattgggttcgagttctgttttcccgtaccatactcacatacccaatggggaaagaatttctaccaaatccatatttatgtggattaaaatcttctcataccctaaccctaatagagaaattctccatgagttaacggctatcgggtcccattgacacctctaga

SEQ ID NO: 5570 - DNA, 177 bp, Zea mays
aaatttagcctctgtcatatcgaatgtttgaacatccgttccaggtattaaatgtagtcggattataaaactaatttgtcagccgaagattaaaagacgagacgaatctagtggttgggtctatatttcatactcctatttaaaagtcaaacgcttgatgtgacccgggctaaattt

SEQ ID NO: 5571 - DNA, 162 bp, Zea mays
ttaggttatttctagattaaaatcaacagaaaatgtctaaattcctatcggacacgtcctcaatataatgtttacagtagaaccatggtgctgcgggttaggattgttgatccaattttggttgagtgacagctgtttttttttcttttagaaaatttaaag

SEQ ID NO: 5572 - DNA, 86 bp, Zea mays
attaccggaatcgcgttctttgccgagtgtctaagacactcggcaaaggctattttacactcggcaaagagctaaattccgatagt

SEQ ID NO: 5573 - DNA, 244 bp, Zea mays
ggttcgttgcctcagttgccacagtttgccacgcctaagttcatgcaagtttgactgagttaggcatgtgtttggtttatagccacaattgtggcaagatttttctcctgctgcgtaggtcccacttgtcaatgacttgtaaaagcgtgtcagattcccttaggcatgccacagttgtggcgcagaatttgagcgcctaaccttaggcaagtgtgacaatttttggcaccttaggcaggaaacc

SEQ ID NO: 5574 - DNA, 142 bp, Zea mays
aggagagggagctgacagaaagagaagtgagcacgcaacagcagctgcgccttggcatctatccattcgccaggagcagccgtatatagatgcagtctggccgatgcgtgctcactctcttctgtcagccacaccgtcgagc

SEQ ID NO: 5575 - DNA, 92 bp, Zea mays
ggccctagaagtcgttggacataagcttatgtccgactgcttgcttggaagctgtcagacataagcttatgtccgacggtggctagagcccg

SEQ ID NO: 5576 - DNA, 248 bp, Zea mays
tctgatgattgcagtcagacataagctatgttcgacagtctctaagagccttcggcaattaaatctgcttacgaccataacaatgaccagtgggccccacatggttatgtccgacggcctcgcatgagcgtaagagctgtgatagtggaatggcgtgggcacgtcgttccatatatccagtgacgtccaacggtcgggccctagaagtcgttggacataagcttatgtccgactgcttgcttggaagc

SEQ ID NO: 5577 - DNA, 108 bp, Zea mays
gatgatccatgctgatttggtgaccagggatctatggggaggaatccccttgctattcacccatggatcccctcgtgatccctggtcaccaaaccagccctaaaggtt

SEQ ID NO: 5578 - DNA, 182 bp, Zea mays
ttcagttgctataggctatgacgccgagttaacacagaacggcggcgacgcggcgggaagaggataacggcggtgtggcatgagaagatctatggtgccgagctaggggtcacgtcggcttgcacgtcaaccctagccgccgtcgtcacgtaagagctcggcgtcataggccatgacgccga

SEQ ID NO: 5579 - DNA, 163 bp, Zea mays
actttaacaaaagacaaagggcctgtttggttcgtgactaactgtgccacattttacctaaggttagtcgtccgaatcaaagaactaacgttagacagaaaagttaggcaaagtgtgttaagttagtcagcgaatcaaacatgccctaagtctctatattatt

SEQ ID NO: 5580 - DNA, 98 bp, Zea mays
gaaaaatattcttgcaggtagaagccatctttccttaggataacccctgagctaggccttattgcaaaagacaacttctatccacaagatctaagcag

SEQ ID NO: 5581 - DNA, 139 bp, Zea mays
ttcattcctttagggctagtttgggaggtccatttttccaagggattccaattttccaaagggaaaatgaactaattttccaaagaaaaatgaaaatcccttgggataatggggttcccaaactatcccctccaatcct

SEQ ID NO: 5582 - DNA, 161 bp, Zea mays
  unsure (71)..(72)..(73)..(74)..(75)..(76)..(77)..(78)..(79)..(80): n = A, C, G or T
gttttcgctggcgcgggcggcctttgcgggattgggggaagcggcggcgtctgggggcgcgtgggcgcgtnnnnnnnnnnacacggcgggtcgtgcggcaggtcgtgcggtggatgcggccgttgcgggcgtgcgagattcgctggcgtgggcgtgcggga

SEQ ID NO: 5583 - DNA, 149 bp, Zea mays
caccagcacctggagcgcgaccatctgctggcggggagggggggggggcttctgttgaaattccttgtccccatcgtgctccacgccgacaaacgaacggggcgcgcctggagctctactcagcagaggaggcagcacgggagcaggag

SEQ ID NO: 5584 - DNA, 176 bp, Zea mays
gagagaggggcacgcacgcagggtcaccggccggtgtgcggaggatcgaaggcgagggcgcgaggctgaagggaagccgctgacgccgtcgctgagatcccgagcctgggcgccgtcgctgagatcccgagcctgagcgccgtcgctgagatcccgagcctgagtgccgccgccgc

SEQ ID NO: 5585 - DNA, 149 bp, Zea mays
ctattaggataaggccttgttcgtttgtgttagattggtgagtcgaaactattcctaaccggattacttctctaatttatataaactttgattagctggaacgatttcggatgcaatccgacacagacgaacaaggtctaaaacataaa

SEQ ID NO: 5586 - DNA, 149 bp, Zea mays
cagccagctttaggctatctccagcaatctacccatccccgtacctatattcaaactatagtctgtgaatagtgtggtctaaaataatgcagaacacagtgcttttggtgatcatatgggttaattactggatacagtcttatatcagc

SEQ ID NO: 5587 - DNA, 153 bp, Zea mays
ccgctgcaaaccagactgtttgcagcctctcacaaaaataaagatagatcctatctatagatccaccagataacattttagttgtgttattagcctgcaggttagatttatcctcctttttgtgaggggctgcaaacagcctgctttgcaggc

SEQ ID NO: 5588 - DNA, 150 bp, Zea mays
cctgcaaagcaggctgtttgcagcccctcacaaaaaggaggataaatctaacctgcaggctaataacacaactaaaatgttatctggtggatctatagataggatctatctttatttttgtgagaggctgcaaacagtctggtttgcagc

SEQ ID NO: 5589 - DNA, 153 bp, Zea mays
cgctgcaaaccagactgtttgcagcctctcacaaaaataaagatagatcctatctatagatccaccagataacattttagttgtgttattagcctgcaggttagatttatcctcctttttgtgaggggctgcaaacagcctgctttgcaggcc

SEQ ID NO: 5590 - DNA, 140 bp, Zea mays
gtcgtccgactaatcgcaattaatcacgattagtcgggttggtcggtaattagtacacgatttgctggacgactcgaccagacaacctagtcgtcctggtcgtccgactaatcgtcgactagggcgactagtcgtccgac

SEQ ID NO: 5591 - DNA, 152 bp, Zea mays
gaactagccttagggctagtttgggagcaagaaaactgaaggagattgaagtgtctaaaattaatgtcttattcaaaattaaataaaaagggaattttagctcctctaattctctccggttttcgggcccccaaattagtccgagaaatatt

SEQ ID NO: 5592 - DNA, 78 bp, Zea mays
gtcgactgacaggaccgaccaggcgcctaatcgcgattagggcgacggttaggtcgactagtcggttccggtcagcct

SEQ ID NO: 5593 - DNA, 87 bp, Zea mays
tcacctaacacactcggcaaagaacactcggcaaaggggccaccagcgggtccctttgtcagtttctttgtcgagtgttttaggagg

SEQ ID NO: 5594 - DNA, 230 bp, Zea mays
aaaatgacgtatgacgaccgttgaaactggtgctttaagtatagtatagatataacatatgctgttttggtaaagtggaggaaaggcgagtagaggcggctgacgaggtgacgcgtgcgtgcgtggcgtccagcgtccccctcccccgtctctctccctttctctctgcagtctgcacgccaaaaaaaaaaaagtcttcagccatctcgacggctcgtcggctcgaccac

SEQ ID NO: 5595 - DNA, 112 bp, Zea mays
tggttcgtggctaactgtgccacagtttgctcctaaggttagtcgtccgaattgaagaactaaccttagacagaaaagtcaggcaaagtgtggcaagttaagcagcgaacca

SEQ ID NO: 5596 - DNA, 141 bp, Zea mays
actaagagcatgtttggttcgctgcttaacttgccacactttgcctgacttttctgtctaaggttagttcttcaattcggacgactaaccttaggagcaaactgtggcacagttagccacgaaccaaacaagccctaaata

SEQ ID NO: 5597 - DNA, 145 bp, Zea mays
ttcccctaaaggcttgttcgtttgtaccggatttatgggttggaacgattcctaatcggattgcttctctaatttatataaactttgattagctggaacaattccgggtgcaatccgacgcaaacgaacaaagcctaaaaaatac

SEQ ID NO: 5598 - DNA, 236 bp, Zea mays
taggtgggtgcccgtgcgttgcaacggaaacatttaatatcatgacaacttatgaacaaatgtgtgttatactgttatgtgaaaatgtttcgtaattaatttgtgatcctagccatacataaattttgttatttcaatctaactatttcatcactacattgcaaccaacagtaccgtgcagacttctatacatgatagctgaatgcccgtgcgttgcaacgggaatatataatacc

SEQ ID NO: 5599 - DNA, 211 bp, Zea mays
gaggtgacgaaggcctggagcgaagggtagcgtcttctccttcgccccaacattttgccctccgagggaccagttcgactgagtcatctagtgccgaagacgtcactagatggtggagacgttgccctcgctcgaagtggttccacgggggtttttgatgtgactgttgatggacgtggtactgttggactgcgggtttcccgaagcgtcg

SEQ ID NO: 5600 - DNA, 126 bp, Zea mays
gctagtttgggagtccaaataccggaggggattagaggggctaaaatcccctccttatttaaaattgaataaggaggcaattttatcccctccaattccctttgattttgtggctcccaaactagc

SEQ ID NO: 5601 - DNA, 234 bp, Zea mays
gctggtgccgctgtgagtgcgacgacgacggggtgggaggtggtcggggatacagaggaggaggagcaggaggtcgagatggagacggtgcggtgggcgatggaggtgggcgtgtgggccaggtgcctcggcgttggcctcctcgcaacggccaggcgcttccggcggaagcgcaccttctggtgaccgctggcactttctctgggtcggtgtggggctgttggggcatcgcgc

SEQ ID NO: 5602 - DNA, 239 bp, Zea mays
gggtattgttgtgagccgtcgcaacgcacagataaccgaccagtatatgtttaattgactagttaggcgtgaatgtaggtttagagccatcatgattcaaatcccaatttatatataactttagcttcttttactatttaaatgtgggggacacaacaatgatgtattcgtggaatcagaaaaaactgatggtttaatatagtcgtgctcatgcgttgcgatggcacacaattatattt

SEQ ID NO: 5603 - DNA, 246 bp, Zea mays
ttaaatataattgtgtgccatcgcaacgcatgagcacgactatattaaaccatcagttttttctgattccacgaatacatcattgttgtgtcccccacatttaaatagtaaaagaagctaaagttatatataaattgggatttgaatcatgatggctctaaacctacattcacgcctaactagtcaattaaacatatactggtcggttatctgtgcgttgcgacggctcacaacaatacccacgta

SEQ ID NO: 5604 - DNA, 137 bp, Zea mays
cactcaataaaaaaacactcggtaaagagttttttgccgagtgtttttttacactcgccaaaaaacttcttttgccaagtgttgttttttttacacttggcaaaaagcttctttgccgagtgttttttaacaatatg

SEQ ID NO: 5605 - DNA, 118 bp, Zea mays
gcactgctctggtagccaaggatgacttgcctgtggcctccatcagtcgcagaggacgctgttcttctgcttgtggttgtcgatcgcaggcagtctccttggctagcccgagcggctc

SEQ ID NO: 5606 - DNA, 152 bp, Zea mays
tttttctccctgaggccttgttcgtttatgtcggattgtaaccggaatcgttccaactaatcaaagtttatataaattagagaagcaatccggttaggattcgttccgacccaccaatccgatagaaacgaacaagggctgagtttgaaggc

SEQ ID NO: 5607 - DNA, 256 bp, Zea mays
tgcctagtgctgcactcggcaaaggggtcgcctctgcctagtgctgcactcggcaaaggggtcgtctctgcctagtgctgcactaggcaaagcttccgttaccgtgccttccgccgtcatggaaacttttcttcaccgagtgacgtgtggcactaggcaaagtgtttgccgagtgcccgagaaatggcactcggcaaaggcactttgccgattccttcgttaccgactccactttgccgagtgcaacactaggcaa

SEQ ID NO: 5608 - DNA, 128 bp, Zea mays
cgcaaagggagcttctttgccgagtgtcaggactacaacactcggcaaagaggctttaccagttctcaggtgtgtcttttttgccgagtgttgtggtcactgcacttagcaaagacactcttttgccg

SEQ ID NO: 5609 - DNA, 82 bp, Zea mays
aaagtggccttaggcgagtcgtgactgcgtctgctacccgagcttggcctcggatgggtcatgactgcgtctgctgcccggg

SEQ ID NO: 5610 - DNA, 163 bp, Zea mays
atggcggcggctgggagggtcggttggggagagagagagggggaggaaacctaatttggctctggtaccatattggaatagtaaaccctaaccctaacaggggttgggtgatgtattaatagaccgagtaaactgggccagacccattacagaggggtgagat

SEQ ID NO: 5611 - DNA, 117 bp, Zea mays
gctggcggccacagtttctatagtgtttggatgagtcacgtgggggcgaggtaaacactaaagtcattttttgtggcggcgtgatcccaaacaatgtagtggacggtgtagccatcc

SEQ ID NO: 5612 - DNA, 103 bp, Zea mays
tgttaaagacgagggtactcacgtttttaatttaaattcgtgggccctagataaaaccatcgaacttaacgagttaggaacgtgggtacccacatttttaagt

SEQ ID NO: 5613 - DNA, 182 bp, Zea mays
tgattaaggatgtttggtttctatggactaatgtttagttcctatattttattttagtatctaaatagttaaatatggaaactaaaattatttagtttccgtatttaacaatttaaggactaaaatagaataaaataaaggagttaaagattagtccctagaaaccaaatactccttaaatc

SEQ ID NO: 5614 - DNA, 137 bp, Zea mays
cttagggtttgtttggtttgtggctaattacgctacattttacataaggttattcgttcgaattgaaaaactaatcttagctaaaaaaagttagataaagtgtggtaagttagacagcgaaccaaatagtgcttgag

SEQ ID NO: 5615 - DNA, 113 bp, Zea mays
aggtgagtgcccgtgcgttgcgatggaaccatataataacacgataacttatgtacatatgtgtgttatattgttataggtatgtgcccgtgcgttgcgacggaagtaaaaaa

SEQ ID NO: 5616 - DNA, 148 bp, Zea mays
atattccttcaggccttgttcgtttgtaccggattggtgggtcgaaacgattactaaccggattgcttctttaatttatataaactttgattaggtagaacgattccggatgcaatccaacacaaaagaacaaggtctcagtgttgtt

SEQ ID NO: 5617 - DNA, 141 bp, Zea mays
tttattagtttagggctagtttgggagcacatatatatctaagagatttttattttcccaaaaaaattagtttattttctcttgagaaaatataaatccattagaaaaatggagtttctaaactagctctaaaatggttta

SEQ ID NO: 5618 - DNA, 162 bp, Zea mays
attttttaatccttttctcggcgtcatagtctatggcgccgaggtaacacagctcggcgccatacgtgttgcgtagcacgtatctcggcgtcatagtctatgatgccgagtcgtgttacgtcagcgtcatatactatgacgctgagcaaatgatctaaaaat

SEQ ID NO: 5619 - DNA, 72 bp, Zea mays
taggtcatagcactcggcaaagaaggcacacctgtgcaccggtaaagcctctttgtcgagtgccaagaccac

SEQ ID NO: 5620 - DNA, 137 bp, Zea mays
attcctcccttagggctagtttgggagccataaaaccagaggggattggaggggttaaaatctccttcttattcaattttagcccctctaatcttctccggatttcggactcccaaactagcccttaggggatcgga

SEQ ID NO: 5621 - DNA, 147 bp, Zea mays
gaggttcggaacgatttctaaccggattgcttctctaatttatataaactttgattagtcggaacgattccgacgcaaatgaacaaggcctaattaaagttcatataaattagagaagcaatccggttaggaatcgtttccacccac

SEQ ID NO: 5622 - DNA, 77 bp, Zea mays
gcgatctctggcctctgctaagccgtcagacataacacagctttatgtccgacggcttagcgggggccgttggacat

SEQ ID NO: 5623 - DNA, 95 bp, Zea mays
gtctgacacaactagcaggctgacgggctatgcttgggccgctaccgtggcacgcgggcctatttagcacgacacgtttcgctaggcaggcctac

SEQ ID NO: 5624 - DNA, 69 bp, Zea mays
ggaaacacacgagacactggatatagggttgggcctctggcctctttctgatctctgtcatatgaagga

SEQ ID NO: 5625 - DNA, 128 bp, Zea mays
gtcggtttcggagcctttgccgagtgcattttagactagcgctcagcaaagaaggctccagtggatccctttgctagtccctttgccgagtgctccgaaaggcactcggcaaaggctccctctttgcc

SEQ ID NO: 5626 - DNA, 151 bp, Zea mays
acatagccttaggccttgttcgtttacgtcggattgcactcgaaattgttccagctaatcaaagtttatataaattagagaagcaatccggctaggaatcattccgacccatcaatccgacacaaacgaacaagaccttagccggcctaga

SEQ ID NO: 5627 - DNA, 135 bp, Zea mays
tttagggcatgtttggtttgtggctaactgtgccacactttgtctaaagttagtcgtttgaattgaataactaaccttagtcagaaaagttatgcaaagtggggcaagttaggcatcaatcaaacagacccggtg

SEQ ID NO: 5628 - DNA, 72 bp, Zea mays
aaggccataacactcgacaaagaaggcacacctgggcaccggtaaagcctctttgccgagtgatgtggcctc

SEQ ID NO: 5629 - DNA, 130 bp, Zea mays
gggctagtttgagagccacaaaaccggaggggattagaggggctaaaatcccctccttattcaattttgaaaaagaagatgattttagcctctccaatcccctccggtttttggactcccaaaccagctc

SEQ ID NO: 5630 - DNA, 117 bp, Zea mays
ggtaagtcttgctgagtaattgcgtactcagggttttattccctgttgtttttcaggttatatttttgttctgttgtggatggtgctaagtgccggtgggctcagccttcttatata

SEQ ID NO: 5631 - DNA, 149 bp, Zea mays
tggtatcattaggccttgttcgtttgcgtcggattgcagccggaatcgtttcagctaatcaaagtttatataaattagagaagcaatccggttaaaaatcgttcagacccaccaatctcatacaaccgaacgacaccttaatcgatgcg

SEQ ID NO: 5632 - DNA, 252 bp, Zea mays
gaggatgtaatgtctaggctttgtttggtggagctgtagcttttccaaaagcacctcctgaagaagctttcgggaaaagcttgggaagctgctccttgaaagcttctctgcttttcgtacaacaaagtgctgcttttatcagcttgaagaagctgctgccctgtttgggggagcctctagctttttgagctttctgtagaagcgaaagctgccagaagctccccaaatagggccttagatcattacgatttt

SEQ ID NO: 5633 - DNA, 149 bp, Zea mays
caaacctcctaaggccttgttcgtttgtgtcggattgcacctgaaatcattccagctaatcaaagtttatatagattagagaagcaatccgattaggaatcgttccgactcactaatccgatacaaacgaacaagatctaaagatattt

SEQ ID NO: 5634 - DNA, 149 bp, Zea mays
aaatatctttagatcttgttcgtttgtatcggattagtgagtcggaacgattcctaatcggattgcttctctaatctatataaactttgattagctggaatgatttcaggtgcaatccgacacaaacgaacaaggccttaggaggtttg

SEQ ID NO: 5635 - DNA, 156 bp, Zea mays
aacttaacattaagaacgtgggtacagtcgaacttaacattaagaacgtgggtaccgtcgaacttaacattaagaacgtgcgtttttaagttcgacgggggccatcgatttttttcccataagttcgtgggtacccacgttcttacggttaagttc

SEQ ID NO: 5636 - DNA, 82 bp, Zea mays
atccctgtgcaaccgaacaaggcctaaggtggaaataacagtttgctctgtcacacctaaggcactgtttggcacatgtctg

SEQ ID NO: 5637 - DNA, 145 bp, Zea mays
tcgctggactgcgtgctggagcaacggcgatcgatcgatctagcgtggggagaggcggataggcgggcgcgcgagggaggagaataagtttgtgccggtggcccggtctcgtcggtcgcttttgttccagcatgcagctgcgtcg

SEQ ID NO: 5638 - DNA, 216 bp, Zea mays
tatacctgtacatgtgggccggcctggcccgacacgacacatgaccacaaaagcacggcccacaaaggcacatatctaattaaggatcatgtcgtgccagcacgtgtgtctagtcatcggcccacgacacggcccacaattagttatgtgtgccaggccgacccaaataacccaaaatgccttaatgtgccagaccggcccatatgtatacaacaa

SEQ ID NO: 5639 - DNA, 139 bp, Zea mays
atactcctttagagctgatttggtgattgggatcctttgagaaaaaatcctcttgctattcaaaattaaattgaaaggagatttctccccatggatcccctcgggatccctaataaccaaattagcccttatagagctg

SEQ ID NO: 5640 - DNA, 170 bp, Zea mays
  unsure (33)..(34)..(35)..(36)..(37)..(38)..(39)..(40)..(41)..(42): n = A, C, G or T
ctgctgaactcgtccttccttgttcctgacctnnnnnnnnnncctgacttcatcgtcgccagagtcctcactggatttgtgtcctcgtcagctagctccaagcccgatctcgtcgtcgttctgtacgtcatcaagaaatcccaagaatcaggtgaagacgaagctagccg

SEQ ID NO: 5641 - DNA, 140 bp, Zea mays
agacgctaaaggcctgtttggtttgatgtctaacttgtcacactttgtctaacttttcggttagttctttaattcgaacgagtaatcttaggcaaagtgtgatacatttagccacgaaccaaacaacccgtggcatctgt

SEQ ID NO: 5642 - DNA, 119 bp, Zea mays
cactgtcccactgcgtctggttcggtttgccccataagagaagagcctgttgcttgccacggaaaaaaatttgttgcagccgggctgcaaaccaggccgtttgcagcccctcacaaaaa

SEQ ID NO: 5643 - DNA, 97 bp, Zea mays
ctgtctaacttgtcacactttatctaacttttctatctaagattagttcttcaatttgaacgattaaccttaggcaaagtgtgacacagttaaccac

SEQ ID NO: 5644 - DNA, 195 bp, Zea mays
actaggtatatgcccgtgcgttgctacggaatcaatacgataaaatccttcacccaatgcacatgagacaatattgagatgtaccaaaaattgtaatgttaataccttaaaaccactaattcagatgccctttaagctgcaagtgattgggtgaagggcatatgcccgtgcgttgcaacggggacacttatacac

SEQ ID NO: 5645 - DNA, 204 bp, Zea mays
ccttgagtattttctcacggtccatctgtgaggtaatgacctagttagattagaaagatttttaaatcactactttttaaagcatcagtttcgtgtgtcgtgcgtggtgcatcacatgcgaagcgcatatgtatgtttctctctggcttctcacctaccaataagtcattacacaacaaatgggtcgtgagaaatcatccaagc

SEQ ID NO: 5646 - DNA, 140 bp, Zea mays
gcgcattgacctgtttggatcgctgtctaatctgccacattttgcctaacttttctgtctaaggttagttcttcaattcgaacgactaatcttagacaaagtgtggcatagttagccacgaaccaaataggcccttaatt

SEQ ID NO: 5647 - DNA, 136 bp, Zea mays
ttatgggcatgtttggtttgtggctaactatgccacactttgcctaaggttagtcgttcgaattgaataactaatcttaggcagaaaagttaggcaaagtggggcaagttaggcatcaatccaaacatgccctata

SEQ ID NO: 5648 - DNA, 89 bp, Zea mays
aagcagaggacgaccgttgatgtgacgcgatggcggaggattgacagcggcggccggctcgacgacactgtcaacggcggcgccgatta

SEQ ID NO: 5649 - DNA, 126 bp, Zea mays
  unsure (41)..(42)..(43)..(44)..(45)..(46)..(47)..(48)..(49)..(50): n = A, C, G or T
  unsure (63)..(64)..(65)..(66)..(67)..(68)..(69)..(70)..(71)..(72): n = A, C, G or T
gaaatcactaagggcttgttcggttgcgagaggattggagnnnnnnnnnnacctgagaacctnnnnnnnnnntccccttcaatccccctcgaaccacttgtaaccgaacatggcctaaggtagtgt

SEQ ID NO: 5650 - DNA, 149 bp, Zea mays
gagatcaattagaccttgttcgtttgtgccggattggtgggtcggaacgattcctaaccagattgcttctctaatttatataaacttgaattagctggaacgatttcgggtgtaatccgacacaaacgaacaaggtcttagctggacgg

SEQ ID NO: 5651 - DNA, 149 bp, Zea mays
tagaaatgctaaggccttgttcgtttgtgctggattgttgggtcggaacgatttctagccggattgcttctctaatttacataagctttgattagctggaacgattccgggtgcaatccaatgtaaacgaacaagccctaagaccatat

SEQ ID NO: 5652 - DNA, 194 bp, Zea mays
actagctgaatgctcgtgcgttgcaacggaaatatataatatcagtatactacgataacttatatacaacaatgtgttataccgttatgagaaaatgtttcattatcaatttgtgattctggccatacataaattttgttatttataatctatctgtttcaccactacattgcaaccatcagtatcatgcagac

SEQ ID NO: 5653 - DNA, 222 bp, Zea mays
  unsure (43)..(44)..(45)..(46)..(47)..(48)..(49)..(50)..(51)..(52): n = A, C, G or T
ccactaagggggtgtttggtttctagggactaatgtttagtcnnnnnnnnnnctacggactgatgtttattcccttcattttattacattttagttccaaaattactaaatatagaaactaaaactttattttagtttctatatttagcaatttatagactaaaaaggaataaaatgaagggactaaacattagtccctagaaaccaaacccccactaaact

SEQ ID NO: 5654 - DNA, 150 bp, Zea mays
taaaacttttagagctgatttggtgatcagaaaaatggaagagatttatagggagaaatctcattgctattcaattttaaatagcaaggggattcatcctccatgaatccctccatttacctggtcaccaaactagctcttataacagac

SEQ ID NO: 5655 - DNA, 155 bp, Zea mays
gtcagtctcttagggctagtttgggagcctcaaacccgaaggggattggaagggctaaaatcccctccttattcagttttgaataagaagaggattttagccccttaaattccctccgggttttagacttccaaattagcacctagctgtgtgga

SEQ ID NO: 5656 - DNA, 74 bp, Zea mays
gaaatacattagggtaggatacaggatgacatactatccatctatatctgtccgttttcaccctagaatttatt

SEQ ID NO: 5657 - DNA, 145 bp, Zea mays
ttcggcaaagagctttttgccgagtgttgtatttatgacactcagcaaagagccctttgccgagtgtcaaaaaaagacactcgacaaagaaactttttgccgagtgtcaaaaataaaacactcggcaaagagcttcttcgctgag

SEQ ID NO: 5658 - DNA, 164 bp, Zea mays
gcgtgcaatcaaactatccagagcatccaatctagatccaacggtttcatatggaaggggttaaaagtaaaataggtactatgttttaagtggaaggggttaaatataaaataacagtcatcattagatctagatcggatgcaccagatcgtttgattgcatgc

SEQ ID NO: 5659 - DNA, 87 bp, Zea mays
tatgtttgtgcaaccatatcggtcggctttgtggtgtgcatgtgtggagcacattaacaatggtcgatgattgaggtaaaggtcatg

SEQ ID NO: 5660 - DNA, 72 bp, Zea mays
atcctcggtggacgacaaccagcgagccctagcttcgtgccggagaggccgcttgtcatcgcctccatcctg

SEQ ID NO: 5661 - DNA, 189 bp, Zea mays
aacttagtgggtgtttgttttcttgggactaattattagttcctctattttatttcattttagtctctaaatcaacaaatgtggaaactaaaaatcatttcatttctatattagataatctagagactaaaatagaataaaattgagagattaaaaattagtccctagaaaccaagcacccactaagtt

SEQ ID NO: 5662 - DNA, 144 bp, Zea mays
agacgtacaccgaccgaccgaccgacctgctgggtcgacgaacgaccgccgccatctctggactcgaccctacctatcgtggattcgtggggggtcgacgaagactgaatagctagcgtgtggtcggccggacggaaccggaca

SEQ ID NO: 5663 - DNA, 184 bp, Zea mays
agaccacggcggcggtttcagccttcggataccgcatgggaggttttacttgcccaaggacaggttcggccctgattcgtgtaggtttcgacagtgacaaggggcctcatcagtggtcgtcaggtcaggggcagtgagccagcacaacactccaaccgaccggtttgaccgccgggatcgcttt

SEQ ID NO: 5664 - DNA, 161 bp, Zea mays
agaaggatgtcaacttgaccatgggagccagcgagttattcaatctttacgacgacgctgccaagagttgcctcccacgagtgaggccaagttttcctgtggtgagcttggttgatccagatgtcatttgcttcctcctcgaggacaagttccgcgatcct

SEQ ID NO: 5665 - DNA, 101 bp, Zea mays
ttgttcgctacggcttgctgcggctgcaatccggctgcggctgcggcttctacagtatttttctctctatggattgcagctgcagcagtccaacagctgca

SEQ ID NO: 5666 - DNA, 117 bp, Zea mays
ccaaacaaaaaacagagccgctccgttccagttcactctgcaaccaaacaaaaaacagagccgctccgatccagcttaccaaacacagaacagagcggctccgttcttagaatcagg

SEQ ID NO: 5667 - DNA, 148 bp, Zea mays
aatctcatttaggctttgttcgtttgtgtcggattgcacccgaaatcgttacagctaatcaaagttcatataaattagaaaagtaattcggttaggaatcattccgacccatcaatccggcacaaacgaacaaagccttactgaattg

SEQ ID NO: 5668 - DNA, 166 bp, Zea mays
  unsure (104)..(105)..(106)..(107)..(108)..(109)..(110)..(111)..(112)..(113): n = A, C, G or T
ggactacggtgcagccaaggatgacttgccgaccgatcaacgagcgacgcctctgatgtctgatctcgacatcatcgtcgtcagaccatcatcatctagctgtnnnnnnnnnntcgtcagatcgtcgccgatcatcggcaagttgttcttggctacaccgtggctc

SEQ ID NO: 5669 - DNA, 201 bp, Zea mays
tagggtgcgtgtctggtagcgagaatagggagaagggtaatagatgtagagacgacgtgagtatcattagtttaatcctcgatgttacctgataatagagtagtcatgtctattttagagtgtgagttgtcctatagttttttataacggagaatctctctcctaatcctccaattcgtcgaagccggacttgcaaatttc

SEQ ID NO: 5670 - DNA, 118 bp, Zea mays
agcgtagagaaccgtttggtcatctatatttagagtacaagaggctttaggctgtctctaacaacaaactctatacactcctgtacgctaaatttagcgatccaagcgtccgctacat

SEQ ID NO: 5671 - DNA, 104 bp, Zea mays
aagtaagggcttgttcggttagctctcaactcaaacttcttcacaattttttccaatcccatccaatccatgtgtattgggaataaccgaacaagccctaagta

SEQ ID NO: 5672 - DNA, 93 bp, Zea mays
ccgcccggcccaagcccgaaaaggcccatattgtttgaatttcgggccggtccggtccgtttgaattttgggtcgtgtcgggccggcccatgg

SEQ ID NO: 5673 - DNA, 227 bp, Zea mays
atatcaaataggcctattagctcagttggttagagcgtcgtgctaataacgcgaaggtcgcaggttcgagacctgcatgggccaagatttttaattaacaattttttaagtcttttttttttcgcaactttgtctaactgtacctgggccgatcgcatggagtatgatcacgctttacttcggcctagggttctgtaacagctgtggcccataggccatagatcacc

SEQ ID NO: 5674 - DNA, 212 bp, Zea mays
gttacaccccgctaaaatttagcctctgtcctatcgaatgtttaaacctccgttccgagtattaaatgtagtcggattataaaactaatttatcagccgaagattaaaagacgagacgaatctagttcagttggttgggtctatatttcatactcctatttaaaagtcaaacgcttgatgtgacccggactaaactttagcagtagcaacca

SEQ ID NO: 5675 - DNA, 82 bp, Zea mays
gtgtcagggccatagcactcggcagagacgcaatacctgggctcttgtatagcttctttgccgagtgttgtggtcctggcac

SEQ ID NO: 5676 - DNA, 255 bp, Zea mays
ctcaatggtgtccgtgttgtggaggctcttcgtcactccgcttggctcgatggtgtccgggcctttgtcgctttaggcgtctgctcgctcccggagttcgacgttgtggatctttgctcgtggtgaagaatcggagctgcctcgtgtgggtgtgttgaggcttggcaacgatggcgcgccgcggtcttattccttgcgtcggtgtctgaatgtaagcgtcgtcgagttgctttggcagtgtgcggctcgtcttgg

SEQ ID NO: 5677 - DNA, 239 bp, Zea mays
actcgaaacagcttctttgccgagtgtctaaaatactcggcgaagcctagaaaactctcgataaagaaaactcgacgaactgtatatcggcaacggcttctttgccgagtactttttatcggacactcgataaatactttgtcggcaaacaaaagtcgccattacggcgaccggtaacggcgacagagcctttgtcgagtgtccactgtactgacactcggcaaagagtatcgctttgc

SEQ ID NO: 5678 - DNA, 169 bp, Zea mays
agtgtccactgtactgacactcggcaaagagtatcgctttgccgagcgtattaggtgacactcgacaaagagatcaccaacggacccctttgtcagcacctttgccgagtgcaccgagagtcactcgacaaaggttgcttctttgccgagtgccaaggccgcaatgctc

SEQ ID NO: 5679 - DNA, 97 bp, Zea mays
agccggttatggagaaacttgttgagcgtcggatgaagatgtgcgtgaagtttgtatagtacctgccaagcgctcgacaaattgtctggatcggaaa

SEQ ID NO: 5680 - DNA, 140 bp, Zea mays
gactattggcatgtttggtttgttgcctaacttgccacactttacctaacatttctgcctaaggttagttcttcaattcggacggctaaccttagtcaaagtgtggcatagttagccacgaaccaaacgtgccctatgtc

SEQ ID NO: 5681 - DNA, 168 bp, Zea mays
cgagcgtcgccgttcgtcgagtgtttgacacttggcaaagattctttggcgagtgtctgactaagccgagtgtgctactctaagtaaagatggtcgttaactcattaccgcgagcgtgatgttgccgagtacccgacaaaaagcactcgacaaagcgccgaacgctcg

SEQ ID NO: 5682 - DNA, 80 bp, Zea mays
attttattttatcttagtctctaaattgctaaatatttagtttctatatttgtcaatttaaaaactaaaaaagaacaaag

SEQ ID NO: 5683 - DNA, 184 bp, Zea mays
gccggccgaccgtgcgagcaagccgtaggatacggctgggcgttgaacgccgccgccacacagccttggcggctactccttgggcagccaccctcttaccctgcttctactcaccgcaaggcatgattataccttgcctttgatcccagccgtccatccaacgcgagctcgcccagggccagct

SEQ ID NO: 5684 - DNA, 219 bp, Zea mays
actcgataaagagtgctttgtcgagtgtccaactctcatcacaccaagtcactcggcaaagcgccgttagcactcgacagtcattaactatgtcgagtgccctaggaaggcgctcgacaaagacattgcctttgccgagagtcacctctagacactcaataaagaagggttttgtcgagtgtattttccagacactcggcaaagtttattttatttttt

SEQ ID NO: 5685 - DNA, 81 bp, Zea mays
atatatacacactaccggaactgagttttttgccgagtggacactcgataaagagccggattccggtagtgacatgccatg

SEQ ID NO: 5686 - DNA, 78 bp, Zea mays
agagctcgagcgcagcctggctcgcgtggaacgcaccttttggtcgtatcccacgggcctggctgaggccaatatttt

SEQ ID NO: 5687 - DNA, 85 bp, Zea mays
gaaagggaagacatgattaaggtcttgcggaatttgagtttgtttcttttgtctagctgcatgactgtggttatggatgctcgca

SEQ ID NO: 5688 - DNA, 76 bp, Zea mays
tagtcgtgtttttgctcagctatgcccttccagtgctatagaacagaagggcacagctgagcaaaaaacacgacta

SEQ ID NO: 5689 - DNA, 75 bp, Zea mays
caaccgacgggaataagggctaaaccgacgggaattacttattcccgtcggtttagtgcttattcccgtcggttc

SEQ ID NO: 5690 - DNA, 83 bp, Zea mays
ccaggaaccgacgggaataagcactaaaccgacgggaataagtaattcccgtcggtttagcccttattcccgtcggttgtcag

SEQ ID NO: 5691 - DNA, 118 bp, Zea mays
  unsure (1)..(2)..(3)..(4)..(5)..(6)..(7)..(8): n = A, C, G or T
nnnnnnnnaggtaatctacgttacttagcgctatgtttgtttcctttgtgtgtgtgtttgcgtgtaggttcattctctacgggtatcaccgtttgcgctaagcacgtttgattccatc

SEQ ID NO: 5692 - DNA, 71 bp, Zea mays
tgtgtgggctgcatctcggtcttttctcgtcgctccagcttgggaatcagacctgatctgcgaggccccgc

SEQ ID NO: 5693 - DNA, 251 bp, Zea mays
tgttgaatataactttggtgacaggaacaaacaatatcaccttaacgtggagggcaattatagcttcacatcgctcgatagtgccaaaccaccacatcctattggtcgtgatagggctagagcgcaatgaagggagaatgattagcttgcatgctttgaggaccattttctggtacagctgagaatgactggtgagcagaaaacaggctggccaggtgaggatcatgtcatgtcacctaagatctactcct

SEQ ID NO: 5694 - DNA, 192 bp, Zea mays
caatactattgccgcctaggtctccgacgtggtggtgggggtgtcgtggcgcccacgtgacgggggtaggcgttatagatcttggcgccagcagtggatagcggatgactacgtcgacattgattcttccgacgacgaaggcacggcgtacgaccagtccactagactcggaacccgggtggaggcggcacc

SEQ ID NO: 5695 - DNA, 136 bp, Zea mays
tgtaggagagcgccgcggcgccgcctcggcgggtcatggcggaccccttgaacagcacggcgtcgtcgccgcctccccctccgtcgttgcccttcccgtcgtccgccgagaccggcagcagcgtgcccctctcccc

SEQ ID NO: 5696 - DNA, 170 bp, Zea mays
gtgagttttgttaagaacgtgggtaccgacattcttacatcagttaagttcatgggtttttttaagaacgtgggtactcatgttcttaaattaagttcgtgggccctagccaaaaccgtcgaacttagcctattagaaacgtgggtacccacgttcttaaattaagttcg

SEQ ID NO: 5697 - DNA, 178 bp, Zea mays
cctactcatgtcgacctctgctgagcgcgctgccaggctcaaggccaagggaaccagcgaaggagagctgggcgacttccccagccgggctgcacgcctgaaggctgcagaggaagcagcggcgctggcagtccaggcagcgaagcaggcagcggctgcagcagaggcagcggcaagg

SEQ ID NO: 5698 - DNA, 118 bp, Zea mays
aaccaaacaaaggatgaagccgctctgttccagttcactctgcaaccaaacaaaaaacagagtcactccgttccagcttaccaaacacagaacagagcggctccgttcctagaatcag

SEQ ID NO: 5699 - DNA, 74 bp, Zea mays
aggactatctcagtgttgtccccagttgtccttcaaaattggagggacgagaggggacgcaatgggacgtccct

SEQ ID NO: 5700 - DNA, 186 bp, Zea mays
aagtaaggtgctccatgcgcaaaatgcatccaaccgatccgttctgtatccacgatgttatcacatttttgcaaataagtcctcacacgctccccgcgttatggttgttcattaaaaaaacctagtacaccgttggatattggacggatgagttggatgcattttgcgcatggaagcaccgacgtc

SEQ ID NO: 5701 - DNA, 188 bp, Zea mays
ggacgtcggtgcttccatgcgcaaaatgcatccaactcatccgtccaatatccaacggtgtactaggtttttttaatgaacaaccataacgcggggagcgtgtgaggacttatttgcaaaaatgtgataacatcgtggatacagaacggatcggttggatgcattttgcgcatggagcaccttacttc

SEQ ID NO: 5702 - DNA, 236 bp, Zea mays
tgttttgcttagagcatctccaacaatgcctcaaactagtgtcttaaattgaactatgaggctctacacaggaaaaaaaactccaacagtgactcaattcataaaatttggtcaaaaaattatagggcaccgtctcaagtgcctcaaatatactacagtgtagtggctaacctataatctagatttgaggctttattgtcggagcgaggtgttttgttggtgccctaaattctaca

SEQ ID NO: 5703 - DNA, 189 bp, Zea mays
  unsure (179)..(180)..(181)..(182)..(183)..(184)..(185)..(186)..(187)..(188): n = A, C, G or T
tttagggggtgtttggtttctagggactaatctttagtccctacattttattctattttagtacttaaaatgctaaatatggaaactaagactctattttagtttccgtatttgacaatataagaactaaaatggaataaaatgaagggactaaagattagtccctagaaaccaaacannnnnnnnnna

SEQ ID NO: 5704 - DNA, 149 bp, Zea mays
tggatcgttaaggccttgttcgtttacgtcggattgcatccggaatcgttccagttaatcaaagtttatataaattagagaaacaatccggctaggaatcgttctaccccatcaatccgacacaaacgaacaagggctaaagaattcca

SEQ ID NO: 5705 - DNA, 90 bp, Zea mays
tccgactcgtctagcaggcgtgttctacagctataatacatagataaaatattgctgtcgtgtacgactcgtctggcaagcgtgttctac

SEQ ID NO: 5706 - DNA, 99 bp, Zea mays
tactaagatattggcacggctcaatcagaaacagcagcggcatagcacatgatctcgcgcgcgtacgtcgtctgagtgagccgagccaacatcatagct

SEQ ID NO: 5707 - DNA, 190 bp, Zea mays
actaagggggtgtttggtttctagtgactaatgttaagtccttttattttatttctttttaatgtataaattgctaaatatagaaactaaaataaggttttagtttctatatttgataattttggaactaaaatgaaataaaatatagggactaaacattagtccctagaaaccaaacagcccctaaagt

SEQ ID NO: 5708 - DNA, 126 bp, Zea mays
tgtgagaggttgaagctgccagcatgatctggctgctcagacgccggcgggcgtctcgagtgctcgctcgatcgtcggtgacgcttggattcaccagatcatgttgcagcttcactctctcgcagc

SEQ ID NO: 5709 - DNA, 212 bp, Zea mays
gttaacccaaactaaaatttagcctctgtcatatcgaatgtttgaacctccgttccgggtattaaatatagtcggattataaaactaatttctcagccgaagattaaaagacgagacgaatttagtccagttggttgagtttatatttcatactcctatttgaaagtcaaatgcttgatgtgacccggactaaactttagtccctacaacca

SEQ ID NO: 5710 - DNA, 105 bp, Zea mays
tgtcgggcttgggccgacactatagggccgagctggtggtccaggcacgacactgtgtacgaatggaccgggtcgtgctttttagtgtcgtgcccgggccacccc

SEQ ID NO: 5711 - DNA, 77 bp, Zea mays
ttagttggttggtgcatgcgcgaaagggcctctagcctagcggttaaggacttccgagtagcacctccatatcctgg

SEQ ID NO: 5712 - DNA, 157 bp, Zea mays
atgaaaaatcagtaaggccttgttcgtttccgtcggattgcacccggaatcgttccagctaatcaaagtttatataaattagagaagcaatccggataggaatcgttccggcctaccaatccgatagaaacgaacaaggcctaagctgtcatcacat

SEQ ID NO: 5713 - DNA, 148 bp, Zea mays
atgacagcttaggccttgttcgtttctatcggattggtaggccggaacgattcctatccggattgcttctctaatttatataaactttgattagctggaacgattccgggtgcaatccgacggaaacgaacaaggccttactgatttt

SEQ ID NO: 5714 - DNA, 86 bp, Zea mays
  unsure (29)..(30)..(31)..(32)..(33)..(34)..(35)..(36)..(37)..(38): n = A, C, G or T
tgtcttcctaagggcttgttcggttgcannnnnnnnnntcaatccccctcgaaccacttgtaaccgaacatggcctaatgggggtg

SEQ ID NO: 5715 - DNA, 79 bp, Zea mays
gctgtcccacgcttgcttggcccgtccattgtttcgcctcgtgtcattagactgtgtccaacaagcaccgctaaagcat

SEQ ID NO: 5716 - DNA, 75 bp, Zea mays
ttggtctcgagtgagttgtgactgcgtgtcccgttcgatggtgggctcgagcgagtcgtgaccgcatatcccgta

SEQ ID NO: 5717 - DNA, 136 bp, Zea mays
gagatagggttcgggtgtgtggcctggttgggggggcgtgtggccgctggcaccatatgccatatgaaaaatgggccgccgctgtgtcggcccattgctcgtgtcggatcggaccaaaacacgcgggcctctgtag

SEQ ID NO: 5718 - DNA, 118 bp, Zea mays
gaacttaatttaagaacgtgggtacccatgttcctaacaggttaagttcgacggttttggctagggcccacgaacttaatttaagaacgtgggtacccacgttctttaaaaaacccat

SEQ ID NO: 5719 - DNA, 217 bp, Zea mays
ttctgcacgtgtggctggtcaagtcaccgttccagcgtggaaggggaatgccgaaagacctccctgcccctgccttatccattcaggtacgcgtgggctcaacaccattcttctccaccagaatgttgtggccacacatgcctaaatggatacaacagggacagagaggtattttggcattcccctgagggtgacttggccagccatgcatgcaaaa

SEQ ID NO: 5720 - DNA, 136 bp, Zea mays
ggttagtttggtggcaagagaattgaagaaaatttatgagtgggaaatcccttactgttcaaaatccatggaattgaataataaaggattttctcctccatggatcacctccaaatccattgtcaccaaaccggcc

SEQ ID NO: 5721 - DNA, 175 bp, Zea mays
gttttttaagttggtgtcctcagtttttgtggtgtgttcacttatactcttagtcgtgttttttgctcagctgtgctcttctgttctatagcactacaaggcacaactgagaaaaaacacgattaaggatataagtgagcacaccatcaaaactgagggcaccaatttaaaaacc

SEQ ID NO: 5722 - DNA, 199 bp, Zea mays
cggtgtccaatttgttgggcacagctgcacccataaaaaagactcaattatatgataggtgataaaaggcttggcgattcaaaaaaaacgcagttaccgctcccacctcgccaaatcaaatggcatatttgtttaccctagtgctgagaattgggccggccaagtctatcgtgcttcgtgccaaatggattcgaaccag

SEQ ID NO: 5723 - DNA, 96 bp, Zea mays
ctaacgagccacgagcatttcgttcagccctatttccttgctacttcgctctttgggcctttaatagggctggacaaaatgctcgttgttcgtcgg

SEQ ID NO: 5724 - DNA, 71 bp, Zea mays
gatgctcggcgccataggctatggcgccgaggtaacacatctcggtgctacatcctatgacgccgaggtgt

SEQ ID NO: 5725 - DNA, 85 bp, Zea mays
catgtcacacctcggcgtcataggatgtagcaccgagatgtgttacctcggcgccatagcctatggcgccgagcatcgagtccaa

SEQ ID NO: 5726 - DNA, 77 bp, Zea mays
cgagccgttgtgaacggtccaatgtaaagaaactactagttagttgcccgtgcgttgcgacggttcacaacaatact

SEQ ID NO: 5727 - DNA, 148 bp, Zea mays
ttgtcacctttagggctagtttgggagacacaaaaccggaggagattggaggggctaaaatcctctccttatttaattttgaataagagaattttagtccctccaattcccttcgggtttttctcccaaactagcccttactaggtga

SEQ ID NO: 5728 - DNA, 104 bp, Zea mays
tcgacgccatagcctatggcgccgaggtacgtgctgcgctggcacgaacggacgtcgtggcgccgacgtggcaccgagctcggcgccatagattttgacgttga

SEQ ID NO: 5729 - DNA, 110 bp, Zea mays
tgttcgacgccatagcctatggcgccgaggtacgtgctgcgctggcacgaacggacgtcgtggcgccgacgtggcaccgagctcggcgccatagattttgacgttgagct

SEQ ID NO: 5730 - DNA, 125 bp, Zea mays
tataaggaacctgtacaccccctcataatacagagaagagaaagaggccagaggcccaaccctataccttgtgtctcgtgtgtttcttctgtcgtgcttatgggaagggagacaggtcttctaca

SEQ ID NO: 5731 - DNA, 69 bp, Zea mays
aggcggttttgtcttagggtccgcttgtgaaaatgatagagcatcacaggcggtcctaaacaaaaaccg

SEQ ID NO: 5732 - DNA, 230 bp, Zea mays
atagttgtacatgtgggccggcctggcccggcacggcacaagcacatctaggcacggctcacaaaggcacggcacacaaaggcacaaccccaattatgggtcgtgccgtgccagcacatgggccgagccaacggcccacggcacggcacacaattacttatgtgtgctaggctggcccaaaaaacccaaaatgtcgtaatgtgccagaccggcccacatataaaatgcaa

SEQ ID NO: 5733 - DNA, 171 bp, Zea mays
aaaaaatgacgcacgacgaccgttgaaactgatgcttttaagtatagtatagatatggttttcatcacgagaactcaaaattgaaactagtagaaatagtcaaatacaggacgcatttcatcttgctatgtaagcaaccgaagtcgtcaaggtccttgcgcgaagacccgc

SEQ ID NO: 5734 - DNA, 160 bp, Zea mays
ttgtggctgcctcttaaggccttgttcgtttacgtcggattgtacctggaatcgttccagctaatcaaagtttatataaattagagaagtaatccagctagaaatcgtttcgacccaccaatccgacaaaaacgaacaaggcctaaagaggctggtgata

SEQ ID NO: 5735 - DNA, 139 bp, Zea mays
tgactaacttttctgccaaaggttagttcttcaattcgagtgactaagggcttgtttggttcatggctaactgcgccacactttgcctaagattagtcgttcgaattaaagaactaaccttaggcagaaaaattaggta

SEQ ID NO: 5736 - DNA, 152 bp, Zea mays
acaccctctgcgcattggacttgcacgtgtgcagccacctggatcccatggacgccatctggacgaaaggggagcacatggacgggcacctggaataggtcgcaataataaccagcggaggcgccctcgtgacggccggtagcggaatgtgg

SEQ ID NO: 5737 - DNA, 85 bp, Zea mays
cacgtcatacctcggcgccataggttgtgcgtcgagctgtgttacctcggcgccacagcctatggcgccgagtatcgggtccaaa

SEQ ID NO: 5738 - DNA, 186 bp, Zea mays
ggttgtggcacccccccccccccccccaattcgccgcactgttcggtagctcctgatgaacagtgcaccatcacaatcagtttctgttttttttcttcttcttttcaacaacaaggtcatggcgcgagcacttgtgttgtgtttttacagtggggggggtggggggggggggggggtcgggtcact

SEQ ID NO: 5739 - DNA, 214 bp, Zea mays
taggagagtgcccgtgcgttgcaacgggaacgtataaaaccacgataaactatgtggcaaatcgagaagttttacatataacggtgttctcgatttgtatatcagttatgcttcctgtggagcaaggaagcgaatgcaagccagcgttttgtattagtgcattctgttcagttcttacttgatcatcccgtgttctcgcgtgtgccatggccga

SEQ ID NO: 5740 - DNA, 217 bp, Zea mays
ctggggaagggaagtggagtggagcgggcgcgagggagtgtggaccggagaggggaccgacgagagtacgagacccagaggagaggtggttgtgcccgttttccggactccggagggtttgactctctcagctcagctgcaagcctgcaagctgctgaaagctgatggtctctctcgttctgtctcggtgtccgtccagatcatagctagcttgccc

SEQ ID NO: 5741 - DNA, 181 bp, Zea mays
cggatgggaatggcagaaccggaatggtggcagaacaaggaatgggcagactactcttagagccttaataagtagtagagattgtgcacggcgatggtgttcggcaggaaagttgtccataaaccagttaaggtcgtacatccgcggcttgaggccgtagcggttcctgcccctgccgccg

SEQ ID NO: 5742 - DNA, 190 bp, Zea mays
cgataagtgggtgtttgttttctatagactaatttttagtttctacattttattctattttagttcctaaattgcaaaatacgaaaactaaacctctatttcagtttccgtacttgacaatttatagactaaatagagtcaaattgagaaacaaaaaattagtccctagaaaccaatcactctaatctta

SEQ ID NO: 5743 - DNA, 81 bp, Zea mays
taattagagcacggcccagcccgcgattcgtgtcgtgctagcccgattttaaatcagccgtgtcgggccgtgctttgttct

SEQ ID NO: 5744 - DNA, 214 bp, Zea mays
gatgacactaaggccctgtttggcacagcttattttcagcttcttcacaaatttaagcagaagttctgccaaacaggcagcttatcagttcagccgcttctcagaatacactaaaaacagccaacaagcagaagctgattttcaccagcttctcagataagctgttttttcaacaagcagtagctgtgccaaacagggcctaagtcgaggtggt

SEQ ID NO: 5745 - DNA, 76 bp, Zea mays
cgcaggtaacggtgacagagcctttgtcgagtgtcctacccgacattcgacaaaggcttcctctttgttttttgtt

SEQ ID NO: 5746 - DNA, 151 bp, Zea mays
actttcattaaggccttgttcgtttacgtcggattgcacccgaaattgttacagctaatcaaagtttatataaattagagaaggaatccggttaagaatcgttccggcccaccaatccggcacaaacgaacaagacctaaagtgcaaaaaa

SEQ ID NO: 5747 - DNA, 78 bp, Zea mays
ggctaattaacctggagttaattttgcgtgacaggctatggctgaaggcagcaagactgacttcgcggagcttgccct

SEQ ID NO: 5748 - DNA, 139 bp, Zea mays
ttccataatttagggctagtttgggagctacatttcccaagaaatttctattttatcaagggaaaatgaattaattccctttgagaaaatgaaaatcccgtgagaaaacaggattcctaaactagcctttataagaaaa

SEQ ID NO: 5749 - DNA, 76 bp, Zea mays
ctcaaagcaccctgagccaggctcaccagatacgagtaaattggtcgcatcggtagagccaggcttcaacagtcct

SEQ ID NO: 5750 - DNA, 166 bp, Zea mays
ggtggagtccggactaagtattggctcggcgcggtggcgctcactagcggtttgttggggaaatgatccctggtctagcggcggccctatatgattacttaggccaggaatcagtatgcttgttaatatcaccagcggcgagccaatacttagaccagcgtatata

SEQ ID NO: 5751 - DNA, 116 bp, Zea mays
cgcttagggtgcgagaggtcccgagttcaattctcggaatgcccccttttcgttcttttttttttctcctttttgtcctttcgatctgtatttggcgctatctcgcctcccaactc

SEQ ID NO: 5752 - DNA, 124 bp, Zea mays
ggttgtgatattggcacggctcaatcaattaaacactgcgcccgcacctcgatcgaatgcgcagaattaagctataagccacccgcggccggcgagttgattgagccatgccaacatcgcactc

SEQ ID NO: 5753 - DNA, 152 bp, Zea mays
accatctaaatgcatgtgcagctctttagctggtcaaagaccgttacttaaatccacgaactttgaaatgcacttgcgtgccacttacatgtcggcgtaccggtgcgtaccgtcgccagatgatgagctagcgcctgcgattccgttatatt

SEQ ID NO: 5754 - DNA, 136 bp, Zea mays
taaagggcatgtttggtttgtggctaaatgtgccacactttgcctaaggttagtcgtccgaattaaacaactaaccttagacagaaaagttagccaaagtgtggcaacttaggtagtaaaccaaacatgcctaaag

SEQ ID NO: 5755 - DNA, 148 bp, Zea mays
catggtcttagggcctgtttggtttgtagctaactgcgccacattttgtctaaagttaatcgttcgaattaaagaactaaccttagacagaaaagttaagcaaaatgtggcaagttaggtagtgaaccaaacagacccttatactcca

SEQ ID NO: 5756 - DNA, 74 bp, Zea mays
aggactatcccagtgttgtccccagttatccttcaaaattagagggatgagagaggacgccaggggacgtccct

SEQ ID NO: 5757 - DNA, 73 bp, Zea mays
taggatctacatgtgttaaggtggattaggatgtaacttatatcccaatccacctcaacaaatatagattaga

SEQ ID NO: 5758 - DNA, 156 bp, Zea mays
attggggaagattgaggccccgttcggttgatagggattggagacccggattgattcctagccggattacttctctaatttatatagattttgatgagctgaaataaatcctggtctattccggtgaaaccgaacagggccttagtgttgtcgtct

SEQ ID NO: 5759 - DNA, 77 bp, Zea mays
caaagtgttacactcggcaaagaacacttgacaaacattttatcggtaaagagttctttagtgggtgttttttcggg

SEQ ID NO: 5760 - DNA, 223 bp, Zea mays
ttaagggataactaggtattaacaggtagcacaaactatctagatttcagacatcaccatatcggcaagcactcatccatgaaccatgattcattcatccatccatcagaaaataaataagtactttgagaccgatagaagaaatggagaaatggagtttgctcaccttccttggtcaccatctatgttcgttggcgcctgagaatccatagttgtcaccgtc

SEQ ID NO: 5761 - DNA, 214 bp, Zea mays
gctgaagactaagggtgcgtttggttgcgggacagccaggacagggacgtcctcaggcgtcctctcttgtccctccaattttgagggataactggggacaacactgggatagtcctgtcccaacccctaaccctgaaccaaacaaccttatttgagggatcgtcctgtcccatcccgtcctgtcaatgcaaccaaacacaccctaagatgatga

SEQ ID NO: 5762 - DNA, 187 bp, Zea mays
gaccaaggcgagagcaggctcggatgagcgaccacacgcgccagagcttgggcagaacgcacgggcacacgtgttcgaccctggtcggcacgccagagctcgcccaacccgcgcacgcgttcgccccggcgtccggtcaagtccgccgcgcgcccacgccctcggccgtgcccgcccgcgcctataa

SEQ ID NO: 5763 - DNA, 181 bp, Zea mays
gatgaacagtgacacgctagatctggggggagagagaagggagccaacgtgtagggtgcgttgtaggggacaccgctgcggccgtagaatgctccctacatgccgcatgcaaggggagggggctgcgtaggggctgctgttgcagttagtcttagatcaggttagtgtgtccaaggctgat

SEQ ID NO: 5764 - DNA, 157 bp, Zea mays
tcttgagtacatggaccgtggatcgcttgcagacattgttaagcaagtgaagactattctggagccataccttgcagtactttgtaagcaggtcttggagggtttattgtatcttcatcatcaaaggcacgtgattcacagggacataaaaccatct

SEQ ID NO: 5765 - DNA, 79 bp, Zea mays
tgaaccctcggatcgaaaaggccgtccctttgcgccggccggccgaccggaggtttggcgctgttcggcggaggagctg

SEQ ID NO: 5766 - DNA, 213 bp, Zea mays
  unsure (104)..(105)..(106)..(107)..(108)..(109)..(110)..(111)..(112)..(113): n = A, C, G or T
tagaacggagccgttccattcctgattttaggaacggagccgctctgttctgtgtttggtaatctggaacggagcggttctgttttttgtttggttgcagagtnnnnnnnnnngttccggatctgaggagaatattctctaattggagtttttccgttctagttactttgtaaccaaacaacaacaaaactgggacagaacggttccgttcta

SEQ ID NO: 5767 - DNA, 159 bp, Zea mays
ttcaggaatagccctggaatttttcaggttgatcaaaacttacataagggcttgttcgtttgtgccgaattggtgggtcagaacgatttctaaccggattgcttctataatttatataaactttgattagctggaacgattccgggtgcagtccaacac

SEQ ID NO: 5768 - DNA, 210 bp, Zea mays
gcaaagaagattctttgccgagtgccataactcggctctcggcaaaggtaacgatcgtcaactttagacggcgactgacggcctttgccgagagccgctcttatctttgccgagggtattcctgtgccgagagtcctgctctcgacaaacggcytcgttaccgagagcagaactttgccgaatatggcactcagcaaagactttttgcgg

SEQ ID NO: 5769 - DNA, 84 bp, Zea mays
ggccggggcgccggcgccgaagctgccgtctttccctgggcctgtcgcccaggcgggcggcgggttcgcgtcggccttgaagcc

SEQ ID NO: 5770 - DNA, 189 bp, Zea mays
cgataaagaagttctttgccgagtgtcaaaaaatactactgagtgtcaaaaataaaacactcagcaaatagcttcttcgccgagtgtgagtgttttattttaccgaggatttttttcgtttctttaccgagtgctcgaaaaaacacttgacaaatatttggcactcggcaaagaaccaaatttctactt

SEQ ID NO: 5771 - DNA, 104 bp, Zea mays
tatacatacatactccctccgttccgttttagatgtcgccgctatttatagattggctgttggaaacgacttgtaaaaagaaatggagggagtacctattagaa

SEQ ID NO: 5772 - DNA, 83 bp, Zea mays
agaccatttgctcggtgtcatatactgtggcatcgagttaacacagctcgacgccatagcctatgacgccgaggtacgtgaca

SEQ ID NO: 5773 - DNA, 221 bp, Zea mays
aacacgcaaggtatagatagccaagtgggccgtgctcaatgagctaagcacgacccgccccgtagtgcttcgtcacatgcacgattcatatagtgtcgtgccggcgctggcactatatgaatcgtgcccgtgccgtgccgtgccgaagcactatggaccatgtcgtgcttagtgtcgacccatttagcacggcccgtttggccatctatacaacaaagaca

SEQ ID NO: 5774 - DNA, 73 bp, Zea mays
tggctaaaagataaagagacgacgtggacgtacggatgcgcgcgtttgcgtcgcgctctatatagtagcaatt

SEQ ID NO: 5775 - DNA, 152 bp, Zea mays
aaaatcactaaggctctgttcggttgttatggatttgagcctcggattgattcctagccggattacttctctaatttatataaattttgatgagctggaataaatcctggtctattccggtgaaaccgaacagggcctaaaggactcagtac

SEQ ID NO: 5776 - DNA, 91 bp, Zea mays
ggattgatggatcggaacgatttcaagccgaattagttctctaaattatataaactttgattagctggaacgattcctggtgcaatccgac

SEQ ID NO: 5777 - DNA, 149 bp, Zea mays
taggtgagtgcccgtgcgttgcaacggaaacatataatactatgatattttatgtacaaatgtccactacattgcaaccatcagtatcatacagacttctatatataactaatacaatatccgtgtgttgcgacgacacataaattatt

SEQ ID NO: 5778 - DNA, 192 bp, Zea mays
cggaatcacgttcttggccgagtgtttaagacactcgacaaagtctattttacactcggcaaagccttcgccgagtataacactcgacaaatatttcatcggcaaaggttctttgttgagtacttttttttcggacactcggaaagactttatcgagtgtcaaaaagcactcgacaaaaaaacactcggtaa

SEQ ID NO: 5779 - DNA, 146 bp, Zea mays
gggacattaagggcctgtttggtttgtgtctaactatgtcacactttgtctaagattaattattcgaattgaaaaactaaacttagacacaagtgtagtaaaatgtgataaattaggcagcgaaccaaacaggccttaaatccctt

SEQ ID NO: 5780 - DNA, 129 bp, Zea mays
gttcatcaccctaaacactatgctgtgggtccacaagtaattgttagtagataaaaaattgatagttgatatagaaaataatattttatagttgtagtggggtataggggagtatttagggggaaccgt

SEQ ID NO: 5781 - DNA, 87 bp, Zea mays
gccttgcatgcactgtgcgccatcatcaaataactgctacttaactccacagatttgtgtttggtgctggcaccacatcatagacat

SEQ ID NO: 5782 - DNA, 240 bp, Zea mays
tcttcgttgtcccgttcttgctacctgctaacatacgacgtatgcatgcgtgcagagtatagaagtgctccatataaactaccaaaaccctatgcttaacacaaagataatatgttcttctagcatctttcgttattgataaagtttggggcttccatattttgaatttggtttttatcgttgttataaaaatgagcatgtccactgaaatgttggtggtggtgggtatgagtactcgtt

SEQ ID NO: 5783 - DNA, 219 bp, Zea mays
gcgaggacgctggaacgctggaacgtagatcctagcggcggaaggttgggaaggaaagagagctggcggcggcggaaggttagggataacttaagggcagctgaggaaaaatcaggtttagtcccctttagccacctcttaagggattagggactaaattggtttagttccttctttagtcactaggtatgtgcccgtgcgttgccacgaagctaaaaa

SEQ ID NO: 5784 - DNA, 183 bp, Zea mays
ggtcccggcagaataaaatctccgaaccctggcctccatacaataacgggccgacatcaaccgtctactctgcaacggcccaaccggagggcacaccgaggggatttttttaaacaagaccgaaaattcgcccccgagtataatggaacccgggacttggaggtgctactcgaaagccttaac

SEQ ID NO: 5785 - DNA, 132 bp, Zea mays
actacctattaaggctgtaaggggtaggctgtctcccctggttctgacttcagccaatctgcaccgtccatctatatgcatcaaatcatcaccgtccgtctcgtcgcctccgcttcaagcctcttccatccc

SEQ ID NO: 5786 - DNA, 84 bp, Zea mays
gggtgcccgtcacagagtggtggagcgtgcaggctttgggtacggaaccaggctaagcggctacactgctccggaccaccccat

SEQ ID NO: 5787 - DNA, 158 bp, Zea mays
ttcatggtcagtcagtagcgacttacgtggcaggttgggcttcaggtggacgatgagctggacgacgtgatgacgtcgtcgtcgaatgcggtgcccagaacaacccgagagtcgccgacgttggcgacgaccatgaggtccccctgcttgacgatgga

SEQ ID NO: 5788 - DNA, 155 bp, Zea mays
ctcagaacgacttaggccgtgttcggttgttagggattggagcctcggattgattcctagccggattatttctttaatttatatagattttgatgagctgaaataaatcctggtctattccggtgaaaccgaacagggccttaggaagcttcacc

SEQ ID NO: 5789 - DNA, 144 bp, Zea mays
agagtgggatgcagccaaggatgacttgccgggtattttgagcatgcatgttacaggggagcatatgcaatctgtttggaattttgagcccataccgtgcggtgcctgtcttccggcaagttgtccttggctacatcttgttct

SEQ ID NO: 5790 - DNA, 74 bp, Zea mays
gtggtggtgcttgtgcgtccattggtgaccgtccacaatcagtaatagagagaccaatgctgcaatgcacacca

SEQ ID NO: 5791 - DNA, 84 bp, Zea mays
ttacgtacctcggcgccgtagcctatggcgccgcgctgtgttacctcggcgccacagcctatggcgccgagcaaagggtccaaa

SEQ ID NO: 5792 - DNA, 234 bp, Zea mays
attggcgacttcaccagcgacgaggagcaccgccgactcctatgagcctaggacgacgatgacgaccatggattctcaggcgccaacgaactcagatggtgaccaaagaaggtgagcagactccatttctccatttcttctattggtcccgaagtactgatttcttttctaatgggtggatgaatggatcatggttcatggatgagtgcttaccgatgtggtgatgtatgaaat

SEQ ID NO: 5793 - DNA, 134 bp, Zea mays
cttagggtctgtttggtttgtggctaatatgccacactttgtctaagtttatcgttcgaattgaagaactaacgttagacaaaaaagttaggcaaagtatgataagttaggcagcgaaccaaacaggcttacta

SEQ ID NO: 5794 - DNA, 93 bp, Zea mays
tggctaatatgccacactttgtctaagtttatcgttcgaattgaagaactaacgttagacaaaaaagttaggcaaagtatgataagttaggca

SEQ ID NO: 5795 - DNA, 76 bp, Zea mays
tcctttctctctccacacagatttagcgtgtcactgttcatcaccctaaacactgtgctgtgggtccacgagtaat

SEQ ID NO: 5796 - DNA, 151 bp, Zea mays
tatccattccactggcaggtgatgtgccgcctcagcatttaatgagacctatccattccgctggcaggcggcgatctgtctattccgcaggtggcgtgcctgtccattccactggtaggcggcacacccatactgccgcgtgcactatgct

SEQ ID NO: 5797 - DNA, 82 bp, Zea mays
atcacaagcggtttttgtttaggaccgcctgtgatgctctatccttttcacaagcggaccctaagacaaaaccgcatgtgat

SEQ ID NO: 5798 - DNA, 76 bp, Zea mays
ctgcggagctccggctcctggcaaagcggaatgcaaacaatcgtatctgcattgccgaggctggtgccattccctt

SEQ ID NO: 5799 - DNA, 203 bp, Zea mays
gcaatggcgcacaacctcaacgtgttgtggatgaatttgccaagcggcatggttccatggtgaatttagagcggcggctatgtttgggtcttgaagagagttaaaacgcgcgtcgttggttgggaatgttgacaactacgtcaccacggatcaccagatccgctcccttccctcccgtcagcagtagaggcgtgagaagctgt

SEQ ID NO: 5800 - DNA, 184 bp, Zea mays
atggaagcgtgcaagcaaaccatcagatccattagatcgtgatctaaccgcagttcacatttaacatttaaatccttcaccaccagctcaataatctttataaaaaaacctctaacaaactatagttgtatctatgattggatcgtaatttaatggatcagatggtttgctgacacatttgtac

SEQ ID NO: 5801 - DNA, 83 bp, Zea mays
cgtaggcatccacatttctctacggtgcacggttctgtcgtcgccagcgctgaaagtcgcctagaggggggtgaataggacga

SEQ ID NO: 5802 - DNA, 80 bp, Zea mays
gggttagtttgagagccacaaaaccggaagggattagaggggttcaatccccttcggttttgtagctcccaaacttgtct

SEQ ID NO: 5803 - DNA, 168 bp, Zea mays
gatttggagacagggatgagacagagcatgggatggggccatcaacaaagtggagggactagcttgcgaggcagaaagaaggtgccagtgccggtgcctccccggtgaaacgatgatgggagtgttgttgctccctcccctgcactgcctcttccctggctccgatcc

SEQ ID NO: 5804 - DNA, 146 bp, Zea mays
tcttaaataataacttatatctgacggctgtcagataagacgtcggacagaagcttacgtccgacggccggactgatagccgtcggacataaaactatgttcgatggcttatctgacagccgtcggacataagttattttaacgcg

SEQ ID NO: 5805 - DNA, 177 bp, Zea mays
ctttttcgcctgattggatgcctgtatctggacgcgcaggctcgggtggccttggctaatccgatacggcaattttctacgtacatgtggatgcaaccaaatagctaaataacttgttttgcatccgctcatgcagcctgcgtctcccttgtgcaggcaaccaaacaggagcttaga

SEQ ID NO: 5806 - DNA, 146 bp, Zea mays
gatgaatcgaaacatgatgccgcgggaaacagacgaagtggagggaaacgacctgcatttattgccgtatggagggaaaatgcctccttgctctgttttggcaccagaaacctccattctgcaacctgagcatcatctcttcttcc

SEQ ID NO: 5807 - DNA, 88 bp, Zea mays
cccaaaaattgtctgggctttcttggcccgaacccgtttggcacgaaacacgatgggcttgggccgggccggcccggcacggcccaat

SEQ ID NO: 5808 - DNA, 148 bp, Zea mays
acagtcccttaggccttgttcgtttgtgttagatttcactcggaatcgttccaattaatcaaagtttatataaattagagaaataatccgattaggaatcattccgacccatcaatccggcacaaacgaacaaggccttatgtgttaa

SEQ ID NO: 5809 - DNA, 98 bp, Zea mays
gagtgttaaaaaaacactcggcaaagaatctctttgccgagtgtcaaaaataaaatatttggcaaatagcttctttgctgagtgtttttttgcttagc

SEQ ID NO: 5810 - DNA, 186 bp, Zea mays
tcccacgccgacggcggcgccggcggcgtcaacatcgcgttcggcgcgccgccgcccgcgcaccaccacgggtacctgttcgctccgacggcggcggcggcaggccatcagatgggcggcggcgtgcacccgggactacaccaccacgtccagttcagcggcgccggcgccggcatcgacggcgag

SEQ ID NO: 5811 - DNA, 132 bp, Zea mays
ctataaacgtttttctagactcagtgagcatatagagtggacggcggtttaaacacaaaagacgtcttagttgaagttgtacgcaattcaacatgagtcatgttggctagagggtggaaggctaggcattct

SEQ ID NO: 5812 - DNA, 192 bp, Zea mays
tggaaaccaatgcgtttggttgcaatgacatgacgggacaagatggttagatccctcaaataagtttagttcagagggttgggacaggactatcccaagattatccccagttatccctcaattggagggatgagagaacgccagtggacgtctctaacctgactgtcctgcaaccaaacacacctaaaaaat

SEQ ID NO: 5813 - DNA, 121 bp, Zea mays
tacaagtcacggctgcaggagctgtgccagaagcggcgatgggcgccgccgttgtacgagcctacccgagagggtcctgcccacgcgcccctcttccgcgccactgtcgtcgtgaatggcg

SEQ ID NO: 5814 - DNA, 113 bp, Zea mays
tgtaaaatagggcattgttatgattgtttttaatgattaagtctatatttcaagacgtggcagtgatttatgccacaggtaaagagcatctccaacaatgtgccacaaaatag

SEQ ID NO: 5815 - DNA, 191 bp, Zea mays
aattaaggggtgtttggtttttagggactaatgtttagtccctagattttattctattttagttccaaaattaccaagtatagaaactaaaactttattttagtttctatatttagcaatttatacaataaaaaaggaataaaatgaagggactaaatattagtccctagaaaccaaacgaccccttaacc

SEQ ID NO: 5816 - DNA, 101 bp, Zea mays
caaagatgcttctttgccgagtgccgcgcagctgtcactcggcaaaggaagctttaccgagtgtcttatgcagacactcggcaaagtatatttttattttt

SEQ ID NO: 5817 - DNA, 233 bp, Zea mays
gtagagctttatgatgtgtttggttcggtgtcaacgagagatgggatgggatcaactctgagttgactccgtcccttattttttaagggatggccccatccactatttttgaaaaatattccttgaccgtgactctagacctccaaaccaaacatgggtcaacttagaatgatcctatcccatccctcttcatccttcctcgtccatccatccaaacactacaagagtgctga

SEQ ID NO: 5818 - DNA, 145 bp, Zea mays
taggtaggtgcccgtgcgttgcgacggaaccatataataacttatgtacatataggtgagcgtccatgcgttgcaacgagaacatataatatcacggtaacttatgtattatatgtctccgttgtaacgcacgggcactcaccta

SEQ ID NO: 5819 - DNA, 112 bp, Zea mays
agtttactaggtgagtgtccgtgcgttgcaacagagacatatattataatacataagttaccgtgatattatatgtctccgttgtaacgaatgggcactcacctagtaaata

SEQ ID NO: 5820 - DNA, 85 bp, Zea mays
gaaccctttgctcggcgccataggctatggcgccgagttaacacagttcaacggcatagcctatggcgccgagatacgtgttgcg

SEQ ID NO: 5821 - DNA, 78 bp, Zea mays
  unsure (67)..(68)..(69)..(70)..(71)..(72)..(73)..(74)..(75)..(76): n = A, C, G or T
cctttggctcggcgcatagccaatggcgccgaggaacacagctcggcgccataggctatggcgccgnnnnnnnnnnag

SEQ ID NO: 5822 - DNA, 250 bp, Zea mays
  unsure (186)..(187)..(188)..(189)..(190)..(191)..(192)..(193)..(194)..(195): n = A, C, G or T
  unsure (240)..(241)..(242)..(243)..(244)..(245)..(246)..(247)..(248)..(249): n = A, C, G or T
ccgctcctccacctcgtcgcagcccccaaggccccaactacccccagtctcggaagagaactatccagaagcgcaagactccaaagccctcctcttgctatccctcccttcctcgccgcgggatcggcatgaatgtacctaccaaaaccctcacggatccctggcattcgatcgcctcactcttannnnnnnnnnaggtcgccttcccattcttcctcgccgcgggggtcgcctgaggtnnnnnnnnnnt

SEQ ID NO: 5823 - DNA, 74 bp, Zea mays
atgctcacgagttatattggttagtgtccttcagttaggcgggagaacgtgaccagttaaacggcctggcccgg

SEQ ID NO: 5824 - DNA, 175 bp, Zea mays
ttggtttgaagtcaaagtaggatgagtcgggggcgccaccgtcccctcgattttttgggatcacgtcgcccccaaaaatcactccggtgctcaacctcgccctcgcttgactctcaaccaaacactatagaaaacgtggccgcctcatctcatccctctttgtacattcaaccaa

SEQ ID NO: 5825 - DNA, 97 bp, Zea mays
caaaggcatcattgagcgcagcgttgatgagccagccgccgtgcctcccctgtcggctgcggcggctcaccagcgctgcactcaattacgcctttgc

SEQ ID NO: 5826 - DNA, 110 bp, Zea mays
taggcacggcactattaggcactattagtaatcgtgtcgtgccgtgccggcactagtgcctaaccagcggcccaggcactacactatagtgcctaatcgtgccgtgccgg

SEQ ID NO: 5827 - DNA, 81 bp, Zea mays
cggtagaatttggtatccgcgagtacgattatggatacatgtatgagttgagttttgtctcgcgggtatggattcgcgaac

SEQ ID NO: 5828 - DNA, 107 bp, Zea mays
taaggcccgccgtgctttgaccgggtgggaagaaaatgaagtaaaaaaaagacagaaaattcactttgctaggattcgaaccttggttggagcattggaatgcctag

SEQ ID NO: 5829 - DNA, 93 bp, Zea mays
atactgccggaattcagctctttgtcgagtgtccgaaagaaaacgttcggtaaatcatttgtcactcggcaaagagccaaatttcggtagtgc

SEQ ID NO: 5830 - DNA, 83 bp, Zea mays
cggacacgctgatcaggttgcgttggtaatcggctgagttatggcattagctgaatattggctgcgccctggcaacacgacgc

SEQ ID NO: 5831 - DNA, 76 bp, Zea mays
aattcaccttaatccacatggattgagatgaattatggtgtaaattgaactcaatacatgtagattgaggtgatcc

SEQ ID NO: 5832 - DNA, 87 bp, Zea mays
tagttcggtcagagctgcaagcctgcaaaagtacagctttttagtgtctccgttgttttctgcatggcatgtactctataagctgtc

SEQ ID NO: 5833 - DNA, 94 bp, Zea mays
gtataaaaagaaaacactcggcaaagaattttttgcagagtgcaaaaaaaatactcgacaaataagctttttactaagtgttttcttttactga

SEQ ID NO: 5834 - DNA, 108 bp, Zea mays
ggaggggccaaaggcctgtaggacttcgctcttgtccgcccgtttgccctggaacagtcgatccaggccaaggaatggtcttgggcggggcgacgggtaactgctccc

SEQ ID NO: 5835 - DNA, 214 bp, Zea mays
tacagtgttttaggatgtgtttggttgcaataataggacgagacgggatgagacgatccctcaaataaggttgttttattcaagattaaagattaggatatgactatctcagtgttgtctccagttgtccctcaaaattggagggacaagagagaatgatagaggacgtccctgtcttagttgtcccgcaaccaaacacacccttacactatta

SEQ ID NO: 5836 - DNA, 106 bp, Zea mays
gcttcgtgcctaaggcgccacaatttgcctaactttttttgtctaaggttagttctcaattccaacgactaagtttaggcagattgtggcgctttaggtggaaaac

SEQ ID NO: 5837 - DNA, 97 bp, Zea mays
ggagacggtagaactgcgcagatcgacgacgcagcatggggctatccaagcaccaacgggacggcgtgggtcggggctgcgcagatctgcggtggag

SEQ ID NO: 5838 - DNA, 161 bp, Zea mays
taggaagttagctaacttcctagaggctacagtcagccgtaggaaattagtcgtaggaagttagtcagctgacgacgctgacagcgtgaagctactatcttctgagaacctactaacttccgagaggcttctttggctgtaggaagttagctaacttccta

SEQ ID NO: 5839 - DNA, 150 bp, Zea mays
tgatcgcctgggtgacctggcgcgcacggtagaacgcctggacgacaattgcgcggcggactagcggctaggttgccaggacagtgcgcgtcccgcgacttttatgtgtttcaggctttcagcgtgtgagttgggtcatcggcaagcagc

SEQ ID NO: 5840 - DNA, 104 bp, Zea mays
ttgacatgtttagggctagtttgggagttcaaaaacaggagggggttagaggggctaaaatccccttcttattctgaactcccaaactagcccttagtgtggag

SEQ ID NO: 5841 - DNA, 115 bp, Zea mays
ttttatatttggtgctagcacggcacaatctaaaagttttttttgtttttttctggcttgaacctgtttgtcacgaagaatgataggcttgtgccgggctggcccggtctggcgt

SEQ ID NO: 5842 - DNA, 239 bp, Zea mays
ttggatccgtgtggcaaacagtttgtcggctaattttagcatattggcctctatacgggctggctaataaattgactaattgttagttgtagggctggcaaaatgtttagccattagccaattaatatatgctaatagatcatataaaaaaacatccatcagccaagacttcaaacataccctaagtaattgttgctagctaattatttaccgactaattgttagccactagcaaataa

SEQ ID NO: 5843 - DNA, 104 bp, Zea mays
ttgctgactaaagggccacaacgtgcctaacttttctgtctaagcttagttctccaattcgagcgcctaaagttaggcagattgtggcgccttaggcaggaaac

SEQ ID NO: 5844 - DNA, 104 bp, Zea mays
gggcgtttggttgccttgtccggtggtgcagctgcatctacacatgcaaaaagtagtgtttgtttggttcgttgtatcgcacgagacaggctagcacggaactt

SEQ ID NO: 5845 - DNA, 158 bp, Zea mays
gtgcttggcgctttgccgagtgtttttttttgtcgggcactcgacaaagaagtctttgccgagtgctgcacttggtaaagtcctgctctcggcaacgaccacgtttaccgagagcaggactctcggcataggaaaacactcggcaaagcggtcgattc

SEQ ID NO: 5846 - DNA, 184 bp, Zea mays
agcctgcatcgccatggcaaggtggctactgctgctcgattcggcttagcaggtggcgcgcctcgtccacctcacggcttggcgaatttttttgtattttagcccctaaaccgaagtaaatttacgtttagacctaaaaaaattttaaatgcagttttggaccctttgctcggcgaaaaaaaca

SEQ ID NO: 5847 - DNA, 249 bp, Zea mays
ggtggctgaacacgagtcgagcgagcttacaagccacaagtattttgtccaatcctagttaggactagttaaacgtatctaattgtgacaaagttttagcaaaaatgtgctaacacatacaagtttaaataatgcacagtaattacatatttcataggagaaaaaacgaataccccgtttggatgtaggtattggtacacagaattggaaattggaataagctttcttgaattctgtcgtttggttgca

SEQ ID NO: 5848 - DNA, 122 bp, Zea mays
gtcttgttcgtttatgccggattgtgggtcggaacgatttctaacctattacttctctaatttatataaactttgattaggtagaacaattccgggtgcaatccgacgtaaacgaacaagac

SEQ ID NO: 5849 - DNA, 98 bp, Zea mays
tgtcagctggccaggttgcttagcgccataggctacaacgccgagctgtgttacttcggctccataacctatggcgccgagcaaagggtccaaaatca

SEQ ID NO: 5850 - DNA, 185 bp, Zea mays
gcggtagactttttacatcacaggcggttcggttagaaaacagcttgggatgtcccaggctattcggaccgtctgtaatgtattagtatcacaagcggtttttgtttcggaccgcttgtggtgctctattcgtttcacaaacggaccgtaatgaaaaaactgcctgtgattgtgatttgattact

SEQ ID NO: 5851 - DNA, 128 bp, Zea mays
  unsure (127)..(128): n = A, C, G or T
ataagccatatgaattgttgttaatgtattggtaatgtattgttgttaattgtcgtgctggtattaatatcatataatatataactaggtcattgtccgtgcgttgcgacggtacacaatcacaacnn

SEQ ID NO: 5852 - DNA, 139 bp, Zea mays
cccgacaaagaagcctttgccgagtgtcgcactcaacaaagtactgctctcggtaacgagctcgtttaccgagcgtagcactatcggcacagaaatacactcggcgagtgtcgaacactcggcgacggcggcgctcgac

SEQ ID NO: 5853 - DNA, 83 bp, Zea mays
tctggttttgggtcaagtagactcggtctttgagcatccgtcatgctgcagctcgaggacgagctgcttgtctaggaggggtg

SEQ ID NO: 5854 - DNA, 92 bp, Zea mays
ggctaaatgtgccacactttgcctaagtttagtcgtccgaattgaataactaaccttagacgaaaaagttaggcaaagtgtgataacttagg

SEQ ID NO: 5855 - DNA, 104 bp, Zea mays
aagttaagaacgtgggtacccacgttcctaatacgataagttcgacggttttaccacgggcccacgaatttaatataagaacgtgggtacccacattcttaaat

SEQ ID NO: 5856 - DNA, 149 bp, Zea mays
cggacgggtaaggccttgttcgtttgtgttgaattggtgggtcggaacaatttctaaccggtttgcttgtctaatttatataagctttgattagctgaaacgattccggatgcaatccgacacaaacgaacaaggtctaaagttttctt

SEQ ID NO: 5857 - DNA, 113 bp, Zea mays
acctgtcgcgggtagcgggtgcgtgtacgagtttaatattaatctcgcgggtacgggtttgtaatctctgtacccgcggattttaaacccgttgccatccctaaacgcgagag

SEQ ID NO: 5858 - DNA, 144 bp, Zea mays
cactcgtttcgtggttagttcggctcggctcggctcgtttgaattttttcacgagctgatgtgacatcctagctcgattcgttcgagccagctcggtttgttaacgaaccagctcgcgagctaaacgagctaccacatttcatc

SEQ ID NO: 5859 - DNA, 116 bp, Zea mays
tcactcggggcgcgtttgccgccatggcccagcatcccgggctgcagctcccgtgtttgtgtcgcctggcttgctcgggagccaggctgtgggcgtgcaaatttagcctctcagcc

SEQ ID NO: 5860 - DNA, 149 bp, Zea mays
aagtggattaagggtttgttcgtttgtgtcggattgatgggtcgaaatgattcctaaccgaattgcttctctaatttatataaactttgattaggtggaacgattccgggtgcaatccgacacaaacgaacaaggcttaaaggaggttg

SEQ ID NO: 5861 - DNA, 252 bp, Zea mays
cgcgatcgaggactggcgggacacgtgtccaggacgtgagtgatgcgcacgttgtgcgatacttatggtggtttggtagttgatcctaaaaaccaccctacgctatgaccgatgaattttgctgagtttgggcttcaaaactcggcggaggcggttccggagggagccggtggcggcacgtggcgtcacaacagagagtgcgtcaaggcgaagaaacttcatgtggaacacgtggccgtcagaacgaaaatc

SEQ ID NO: 5862 - DNA, 195 bp, Zea mays
agcaggtgcaagtatgtaagtagagtttttagtctttagatatgtatccaacggtagatacaattgtagtttgttagagagtttttttataaagctatatcatgtggtggtggaagagtttaagtgttaaatatgacatactgttggatctagatctaacggacgaaaaaatctcttgcacctaatacctgattg

SEQ ID NO: 5863 - DNA, 99 bp, Zea mays
gagagtttgacactcggcaaagccccctttaccgaatgtctttctatgtatagtgtctcgctgtcggtaaacgaggctgttgccgagagtcttatttcg

SEQ ID NO: 5864 - DNA, 91 bp, Zea mays
gagtaggccgtaggaagttagtaggggcggctaacttcctagaggaggccgtaggaagttagcggctcgtttgaccgtctgcggtggtcag

SEQ ID NO: 5865 - DNA, 109 bp, Zea mays
tggttcgtggctaaccgtgccacactttgcctaaggttagtcgttcgaattgaacaactaaccttaggcagaaaagttaggcaaagtgtgataagttaggcagcgaacc

SEQ ID NO: 5866 - DNA, 153 bp, Zea mays
tttttcagtttagggcccgttcgtttgcataggaataaacctagattcgttccagctcatcaaaatttatataaatgagagaaataatttggctaggaattattccggatctccaatcagtggaaaccgaacagggccttatagtgctcggat

SEQ ID NO: 5867 - DNA, 175 bp, Zea mays
gaaagtcaaaaggctttgctggatcggatcttgctttcagcctttcagaaagctaaaaactaaccaactgacgaatttcagaaaacaaacagggtaagagagaaaaaaaggtagaatagcaaaagaaaagcttataccctggtgatgtgcccgtgcgttgcttagtgatggtgat

SEQ ID NO: 5868 - DNA, 214 bp, Zea mays
  unsure (84)..(85)..(86)..(87)..(88)..(89)..(90)..(91)..(92)..(93): n = A, C, G or T
  unsure (104)..(105)..(106)..(107)..(108)..(109)..(110)..(111)..(112)..(113): n = A, C, G or T
agatactaggtgcaagcacgcaagaagacattttgattcgttagatctagatccaacgatattcataggggatcctctagagtnnnnnnnnnnagcagcaggtnnnnnnnnnnttatagcatttaaaaaaacctaacaaactacaattgtatctaccgttggatacagatctaacagactaaaaagtctgcttgcacgcttgcacctagtacct

SEQ ID NO: 5869 - DNA, 75 bp, Zea mays
acgattcctaaccggattgtttctctaatttatataaacttatattagctggaacgattccggtgtaatccgaca

SEQ ID NO: 5870 - DNA, 234 bp, Zea mays
tcctaacaccgtccataaggtcatgcgctgccgtactcctgatatggcgtactgctccatccgtccagtatacgggtccctataccatgtgtttggttccgatgctaggcagagcctagttcataagctcatgcaggccaagccaagcctgtattagtggatgcaagtaataatttgtgtggttgtttggttgactgcacgtaactagccaggatttggtgggcacgtgtttgg

SEQ ID NO: 5871 - DNA, 103 bp, Zea mays
tatgaagggggtcgatgccaagatctatggcgccgaccccctgacatgtgttcgtcggtgccacgggtcggcgccaagatctatggcgccgaccccccctgcc

SEQ ID NO: 5872 - DNA, 89 bp, Zea mays
ggggtcggcgccatagatcttggcgccgacccgtggcaccgacgaacacatgtcagggggtcggcgccatagatcttggcatcgacccc

SEQ ID NO: 5873 - DNA, 229 bp, Zea mays
ataagacttatattggctctgtttggcacagcttattttcagcttctttacaaatttaagcagaatttctcctaaacagctagcttccgcagcagcttatcagttcagatgcttctcagaatatactaaaagcagccaacaagcagaagctgcttttcaccagcttatcagataagctgctttttcaacaagcaacagctgtgccaaacagggccattatatgcaccta

SEQ ID NO: 5874 - DNA, 158 bp, Zea mays
tcgtacataccctaagggcttgttcgtttctgtcggattgcacccagaatcgttccagctaatcaaagtttatataaattagagaagcaatccggttaggaatcgttccaacccactaatccggcacaaacgaacaaggcctaaggttttttcttgcc

SEQ ID NO: 5875 - DNA, 132 bp, Zea mays
aaaagatgacgcaggacgaccattgaaactggtgttttaagtatagatatagagaaatagagataaataaatatgcttaattcatatcgtcttttcataggtaggtttggtggtttttctgtgaacatatcc

SEQ ID NO: 5876 - DNA, 140 bp, Zea mays
aaaccagactgtttgcagcccctcacaaaaaggagaatagatcccacctgcaggtgcaacaatacaatcaaaacgtgacctgcagatgaggtctacctcctttctgtgagagaggctacaaacagtctagtttacagtcg

SEQ ID NO: 5877 - DNA, 231 bp, Zea mays
ctcctttgttgttaacactgtgtactcggtttctctggcgctgatccgcgctcgcccatgtcgccatcgtagtatcgtcgctagtgatagcttcgtatcgtcgtcgagtctgtcgaacctcgttcttccctgctcgatctcgtcgaacccgaagcccggacttcaaacaaaaataagcgaggtccatgtgcatcgcttatcaagtgctcggtcgaagactttgatcgaagg

SEQ ID NO: 5878 - DNA, 73 bp, Zea mays
tgggcttctttcctgtggaccatgtgacattgaattaccttaaactgacaggccgcagtgatgaaactgtatg

SEQ ID NO: 5879 - DNA, 211 bp, Zea mays
  unsure (190): n = A, C, G or T
ggtagcaaggatcaggggcggacctacgttatggtgagtgagggcctaggcccctgctcatttctatgatattatgatatagtatagatttttaccatggagtcccctccttgatttaactgagatgcccctgctcttacattttaatccttgatcttgtaagaatgccctcactctaattttatcctangtccgcccctggcaaggatgg

SEQ ID NO: 5880 - DNA, 101 bp, Zea mays
ctggcccgacacagttagcaggccggcatgacgtgcatgtgccatagttgtggcccgcgtgtatctagcccgtgtcggacgtcgttatgctgatttaatta

SEQ ID NO: 5881 - DNA, 189 bp, Zea mays
tgaataaggggtgttggtttctaagaactaatgtttagtcccatcattttattccattttaatctataaattgtcaagtttagaaactaaaatatagttttagtttctatatttggcaattttggaactaaaatggtataaatgtatggactaaaaattagtccctagaaaccaaacgccccttaagtc

SEQ ID NO: 5882 - DNA, 253 bp, Zea mays
ggccgggaaggccgtggcagcgacggatccagcgaagacgatgaagagggtgggtgacatgtctaagtgcatgtctaagttctacttctaattatgatgtattggtgtttttcctatgttgtttaaaactacgtttaaacaaagtttaaacatttaaaagtcaaaattttaccatgagcgttccaacgttttatcgttttaataaccttgactagttatatacccgtgcgttgcaacggcaaacaaattgatg

SEQ ID NO: 5883 - DNA, 213 bp, Zea mays
caaagcaacttaggatgtgtttggttgtaatgacagaacgagatgagataagacgatccctcacataaggttgtgtgttttatggtcaggggttagaacaggattatcccagtgttgtcccttaaaattgaagggacgagagaggacgtcaggggacgtccctgttctgtctgtcctcatatgtcccgcaaccaaacacatctttcaattaga

SEQ ID NO: 5884 - DNA, 208 bp, Zea mays
tactctattaagaacggagcgtcaacgtccacacctagcgtgcctccgcctctcccccgcgtgtgccctcgtccctgcctctccctgcccgtagctaaggtatatgtccgtacgggcggcgcggacggattgggcgaagacggggcacgcacttgggagagacggggcacgctaggtgtgggactgaccatccgttcttcatagagta

SEQ ID NO: 5885 - DNA, 228 bp, Zea mays
tgtttgtataagagcatctccaacaatatctcggtgtccaaaattgaaacatagggctctatgcagtaaaaattaatccaacagtcccgcatttataaaatttggtaaaaaattataggataccctctcaagtaccttaaatatactacactgtcatgagctgcattagaatctagatttgagattttattgttggaacgaaatattttgttgatgccataaattcta

SEQ ID NO: 5886 - DNA, 134 bp, Zea mays
gcagagagcggcgttggcacctggtggcagacgccggcgtggtcaccttagactgtgttcagcggttacacctaaatttgtccccctaaatttgtccccttatatcccactcacgtgtcacgtcagcgttctct

SEQ ID NO: 5887 - DNA, 236 bp, Zea mays
cgtaaacagaccgtacttgtgccagcacgtgggccacgaactcggcccaagcacgacctaatacacaattttgggtcgacccaacccaaaattattttgtaccgtgtcgtgcttgggtcttatttttcttttcatggtttcgactagtctaccaggcttgacctaaatgtacacctctaactcagaccagcacaagcacatgaaccacgacctcggcccaagcacgacccgataca

SEQ ID NO: 5888 - DNA, 169 bp, Zea mays
cgacgttttggaggcgtaggcgagggattagctgatatagaaaagcagggaatagaccactcgctaaaacgaacaagaacactctattacttggtaacctctttgattaaaaccatagatactcacgtcgtctacatctgttatctctctcctagcagccgtcgttctt

SEQ ID NO: 5889 - DNA, 130 bp, Zea mays
aaggctaagggctgatttggtgaccaggaatcacgagatgagtaatccctttgctgttcgaaattgaataggagattcctcctcatggatcacctcatgatctctggtcaccaaaccagccttaaaggaa

SEQ ID NO: 5890 - DNA, 163 bp, Zea mays
ggcggcgtgggcgtgggcgtgggcgtgggcgagattgcgggcgtgcgcgagatctgggggcgagggcaggacggacttccatgcgcgggcgtgggagggagcggaggatgtcgcgggaggcagaaccgtggtgtgtgcacgcctacactacgtccttaagaga

SEQ ID NO: 5891 - DNA, 136 bp, Zea mays
tggacgaaatgctcgtggctggctcgtttggtttatggtcggttcagcttggattggctcgtttgaattttttcacgagctgagctgatatcctatctcggttcgttaacgagccagctcgcgagctaaacgagct

SEQ ID NO: 5892 - DNA, 136 bp, Zea mays
taggtgaatgcccgtgcgttgcaacggaaatatataatacaacgataacttatgtacaaatatgtaatatattgttatgagaaaaggtcctcaagcacttatttgatctgagcgacgacgatggagacttcaccgg

SEQ ID NO: 5893 - DNA, 144 bp, Zea mays
tggctcgataacactcgacaaatgctttactgagtgtgcttggtaaataggactcggtgaattatacattgacaacagtctctttatcgattcctttatatcggacactcggtaaagactttgccgagtgtcaactggtgctcg

SEQ ID NO: 5894 - DNA, 95 bp, Zea mays
ctgttcttgctcgcgagctaaacgagccaactccagctcgtaaacgagccgagtcgagctgactctatggctcgttagctaacgagatgggacga

SEQ ID NO: 5895 - DNA, 111 bp, Zea mays
ttggttggtggctaaatgtgccacactttgcctaaggttagtcgtttaaattgaaaaactaacattagacagaaaagttaggcaaagtgtggcaagttagtcatcaaacca

SEQ ID NO: 5896 - DNA, 114 bp, Zea mays
cttcatcagtgcgatggcggacttgttgtccaccttgagcttgggagcgagcactgctcctccgatgagctcagccagcagccgtgccaaccagactgcctcgcacgcggccgc

SEQ ID NO: 5897 - DNA, 221 bp, Zea mays
catacattaaggagtatttaattgttatatcatcaccggagtttttgcaaaagtagtcatcattgttcggaatgcagcggaataaaactaacgataagtaaacggaaggatggggaagcctgtcccatcactcctcgtgctcctcctcagctgaggtagggtcccactcgactatccatcccggtggcaagatggacggccaagtcactccagcaaccata

SEQ ID NO: 5898 - DNA, 147 bp, Zea mays
aattctctaagttattgttcggttatttccattatatataggttagatatgattagaaaaattttacaaaaactttaactttttaggatttaaacccacctaacccatatgaattaagagctaaccgaacaagccgtgagtctgcac

SEQ ID NO: 5899 - DNA, 130 bp, Zea mays
gtttacacatctcggcgccatagatcttggcgccgagctacctgtcgcgttgtcgtccaccagttgacgcggcgccgacgtggcaccgagctcggcgctaagatctatggcgccgagctcgaatatataa

SEQ ID NO: 5900 - DNA, 127 bp, Zea mays
tatattcgagctcggcgccatagatcttagcgccgagctcggtgccacgtcggcgccgcgtcaactggtggacgacaacgcgacaggtagctcggcgccaagatctatggcgccgagatgtgtaaac

SEQ ID NO: 5901 - DNA, 74 bp, Zea mays
ttgtcaatcaggctctacgcatgcgaagtatgtgtttggttacctgcgtgcagatgtggagccagactcgcaca

SEQ ID NO: 5902 - DNA, 120 bp, Zea mays
aggacttctaaggtcttgttcgtttgtgccggattgcttctctaatttatataaactttgattagctggaacgattacaggtgcaatccgacacaaacgaacaaggtttaataccgaaat

SEQ ID NO: 5903 - DNA, 152 bp, Zea mays
taggaccgattgaggccttgttcgtttacgtcggattgcacccgaaaccgttccagctaatcaaagtttgtataaattagagaaacaatccgggtaggaatcgttccgacccaccaatccgacgtaaacgaacggggcctgagggagcaaaa

SEQ ID NO: 5904 - DNA, 82 bp, Zea mays
tgtatttcgggtatccgacccgataggacccacgggtgagtttttgtacccgtatccatatccggtgggtacgaaatccgcg

SEQ ID NO: 5905 - DNA, 115 bp, Zea mays
gcaccctccatatctaacggtgttgcgtctattttgtaaagaagcctctacactcttgctctgtacattttacaaaaacctcccctgacgcagcaccattggatgtggagggtat

SEQ ID NO: 5906 - DNA, 135 bp, Zea mays
aatccagaccgcaccctccatatctaacggtgttgcgtctattttgtaaagaagcctctacactcttgctctgtacattttacaaaaacctcccctgacgcagcaccattggatgtggagggtatggtctggatt

SEQ ID NO: 5907 - DNA, 228 bp, Zea mays
cttgagactaagaccctgtttggcacagctactacttgttgaaaaagcagcttatctgataagctggtaaaaagcagcttctgcttgttggctgcttttagttcattttgagaagcagctgaactgataagctgctgcagaagctgtctgttttggcagaacttcagcttaaaatttatgaagaagctgaaaattagctgtgccaaacagggcctaaaaggctttgtg

SEQ ID NO: 5908 - DNA, 67 bp, Zea mays
tgccacactttgcctaaggttagtcgtttgaattgaataactaaccttaggtagaaaagttaggcaa

SEQ ID NO: 5909 - DNA, 72 bp, Zea mays
agaaatttaacgacttatggtcggtcgctatagaggtaaatgtgtgactgatggtgggtcgctataggggta

SEQ ID NO: 5910 - DNA, 92 bp, Zea mays
ccgtgcctaccaattaaccgtgccgggctcgtgcctgcaccgcggggccgacggccagcccaagcccggcacggctattgaaccgggccgat

SEQ ID NO: 5911 - DNA, 206 bp, Zea mays
caagcgagccgctaacttcctagaggcagccgtagcaagttagcatgggcagctaacttcctatggcctcctctaggaagttagtttttagttgctgatccgcagttgtggtcaaataaaaagctaacttcctacggccggctctaagaagttagcatggacagctaacttcctacggcctcctctaggaagttagatttcagctt

SEQ ID NO: 5912 - DNA, 90 bp, Zea mays
gaggtttccggcgtgcgcaggcgtgcggagctgtgcggtggtgggcggatttggcggcgaggtttccggcgtgcgcaggtgggcggaggt

SEQ ID NO: 5913 - DNA, 196 bp, Zea mays
acgccggtgctcccatgtgcaaaatgtatccaacccatccgtccaatatccaacggtgtaccgggtattttttaatgaacaacactaacgtggagagcgtgggaggacttatttgcaaaaatgtcataacacattaacaccgttggatacagaacggatgagttagatgcattttgcgcatgggaacaccgacgtc

SEQ ID NO: 5914 - DNA, 86 bp, Zea mays
gaacccgaaactcggcgtcatagcctacgataccgaggtaacacagttcagccccataggctatgacgccgagctctgacgtggcg

SEQ ID NO: 5915 - DNA, 255 bp, Zea mays
taatttatataagagggtgtttggttgctgctgctaaagtttagtacgggtcacatcaagcgtttgacttttaaataggagtatgaaatatagacccaaccaactgtactagattcatctcgtcttttaatcttcggctgacaaattagttttataatccgactacatttaatacccgaaacggaggttcaaacattcgatggaacaggggctaaattttagcggggtgtaaccaaacaccccctaagttttggt

SEQ ID NO: 5916 - DNA, 86 bp, Zea mays
gggagtcgagcaggggatgacgggttcgacgacttgactgtgaacgacacaaggacgaacgacgacaaccggtgagatcgacgaca

SEQ ID NO: 5917 - DNA, 191 bp, Zea mays
tgttgtccatcgtcgagcaagaagacctcatggtcattgtcaacgtcggtgactctcgggttgttctggacaacacatccaacaacggcgccatcacgccgtccagctcatcgtccaactgaaacctaacctgccatataagtcgctactgatcggccatgaattcttgtgcgctgggacgatggtcatta

SEQ ID NO: 5918 - DNA, 203 bp, Zea mays
tgggcacgtaatgggcctgtttggtttgtgtcaaaatgtgtcacactttgtctaagactagtcgtccgaattgaataactaaccttaagcataaaagttagacaagatgtgataagttagtcagtaaaccaaatatatcctatatgtcctcgctcggcatgacctatcccggacacgaattaggcatggcccgaattaggcag

SEQ ID NO: 5919 - DNA, 111 bp, Zea mays
tttatacttggcaaagcctttgccgagtgttcggcaaacattttatcggcaaagggttctttgccgagtactttttttcggacactcagtaaagactttgccgagtatcga

SEQ ID NO: 5920 - DNA, 246 bp, Zea mays
taaattttgattagctggaacgattccggttgcaatccggcacaaacaaacaaggtctaagggcctgttcggttattcaggaatctactccaggaaagattccaactggaataattgtataatttgtagtataaattggtaacctgaaatagttcctagccttttccagcctaaccaaacagtgtctaaggtcatgttcgttttggttggattgcacccagaatcgttccagctaatcaaagttta

SEQ ID NO: 5921 - DNA, 142 bp, Zea mays
aacactaagggctgatttggtgaccagggaattgaaggaatccataggagaggaatcctcttgttattcaattttaaatagaagggaattcctcccatggatcccatccatttacctgatcaccaaaccagccctaagtaaa

SEQ ID NO: 5922 - DNA, 167 bp, Zea mays
ccgctctaaggtcctgtttggcacagcttattttcagcttcttcataaatttaagcaaaagttttaccaaacagccagcttctgcagcagcttatcagttcagctgcttctcagatacactgttttttcaacaaacagcagctgtgccaaacaaggcctaatcagac

SEQ ID NO: 5923 - DNA, 148 bp, Zea mays
gagcttatttaggccttgttcgtttgtatcggattgcacccggaaccattccacctaatcaaagtttatataaattagagaagcaatccggttaggatttgtttcgacccatcaatccgacagaaacgaataaggccttaagatgaaa

SEQ ID NO: 5924 - DNA, 146 bp, Zea mays
ccgctcctccacctcgtcgcagcccccaaggccccaactacccccagtctcggaagagaactatccagaagcgcaagactccaaagccgtcgccttcctatccatcccttcctcgccgcgggggtcgcctgaggtatgctacctac

SEQ ID NO: 5925 - DNA, 153 bp, Zea mays
agacgtccccatcgtcgtcgtcggccacggccgccccctccaccacgacgcacgtcttgggactcgacagctcgtcgagaacggttctcggaccgagcggagcgtacgagtacgaccaggcgaaagcggagctcgacgacggcaggggcagcg

SEQ ID NO: 5926 - DNA, 226 bp, Zea mays
  unsure (181)..(182)..(183)..(184)..(185)..(186)..(187)..(188)..(189)..(190): n = A, C, G or T
gcgaagtagcccgcgcttggggtcgacttggcttgtctttcgcatcacgtggttaattcacgtacctcggttatgccttggtgtggaggtaaacaagacatcgtggcacacggaataagctcagggcgacatcagaaacactggactcttgttgcaaagtcgaggtgatatttgagacctnnnnnnnnnntttgagacgaagtcgatgttggccggtgttacagag

SEQ ID NO: 5927 - DNA, 133 bp, Zea mays
atgtagtatctcattctaacagactctccaacatgcaagtttgtttggatagccgaagtggctagccaagtttggatagtgaggcggatatcttggcgagttgaatggctagtctgtttgagttattttgcta

SEQ ID NO: 5928 - DNA, 149 bp, Zea mays
gaatttgctaaggccttgttcgtttgtgacggattggtagttcggaactatttctaaccgtattgcttctctaatttgtataaactttgattagctggaacgactttggatgcaatccgacacaaacgaacaaggactaagttgtgtcg

SEQ ID NO: 5929 - DNA, 149 bp, Zea mays
ggaatttgctaaggccttgttcgtttgtgacggattggtagttcggaactatttctaaccgtattgcttctctaatttgtataaactttgattagctggaacgactttggatgcaatccgacacaaacgaacaaggactaagttgtgtc

SEQ ID NO: 5930 - DNA, 258 bp, Zea mays
cgggggatgttagactatgtgtgtgggtcggcaccactgttgggctatcggcccattagggttagggtttcccctgagtctatatatgtaaccttcctctatgcaatagatatagagtttcattctccaatagcatggagccatgaagtatgtgaaggcactgtaatgagttcataaacacctataaagctaggacaataatacacaaaaataacatgaacctattcaaggattcaccacaagtaataacaccaaatg

SEQ ID NO: 5931 - DNA, 183 bp, Zea mays
tatacactttgttgcccttagttttgttggtgttcttacttttatctttagttgtgtttttttagttttgtccttccagtgctatagaacatgctatacaacagaagcactaaaccgagaaaaaacacgactaaggataaaagtgagtacaccagcaaaactgagggcacacgcttaaaaaac

SEQ ID NO: 5932 - DNA, 117 bp, Zea mays
aacctattactccctccgtttctttttatttgtcgctgttgcactatccagcgacaaataaaaagaaacggagggacaacagcgacaaataaaaagaaacggagggaatacaagtga

SEQ ID NO: 5933 - DNA, 222 bp, Zea mays
tatttagaaatattaactatagtttaactataaaattaattacataaataaagactaaatgacaagtggatctattaagtctaattagtctatagtttttttgatactatggtaaatatttactaatcatagattaattatgtttaaaaattctttagtcatttacttctcatctatgtaattagttttataattagaccatatttaatactcatacccgtc

SEQ ID NO: 5934 - DNA, 67 bp, Zea mays
ctcttttagatccaaatggtttaggattaggctgcatatgaaattctaatccgtttgaacttaagag

SEQ ID NO: 5935 - DNA, 163 bp, Zea mays
cgatggaggagaggctgaagctgagtcgcgacagcacgacggaggaggtggatgctactcagtaccagcgtctcgtggggagccttcgctacctcgtccacacacggcctgacttggcatactccgtcggctacgttagtcggtttctgcagcgaccgacgac

SEQ ID NO: 5936 - DNA, 105 bp, Zea mays
cccgaagagattgacagaagagagcgagcacctggcgcggcgaccggcatggaacgcatgccgtccccgccgcgtgctcgcttctctttctgtcagcctctccct

SEQ ID NO: 5937 - DNA, 88 bp, Zea mays
tgttccgcctgctcttcccgccgttccagaagtacatcaccaaggggtacgtctccgaggaggaggccgggaagcggctggcgcaggt

SEQ ID NO: 5938 - DNA, 68 bp, Zea mays
gggaccgtctgtgtctatgatttgtgggtccgatggcatactgggcgaagcccacaaatgataaggca

SEQ ID NO: 5939 - DNA, 157 bp, Zea mays
tgttcgtttgtgtcggattgatgggtcggaacgaatccgagctggattgcttctctaatttatataaactttgattagccggaatgattccgggttaattagagaagcaatccggtccggaatcgttccgacccaccaatccagcagaaacgaacaa

SEQ ID NO: 5940 - DNA, 110 bp, Zea mays
agctatattacctcccgttctcgttatcccgctagttcatttttaacgaaacagtgacaaatatgaactaaacagcaacaaataaaaagaaacggaggggtactacgctt

SEQ ID NO: 5941 - DNA, 198 bp, Zea mays
attgaatatagttggattgtaaaactaattacacagataataactaacgataagacaaacctattaaatctaatcagtccatgattcacacatataatgtaaacatttgctaatcatggattagttggctttaataaatttgtctcgtcatttagtcttcaactccgaaattagttttataatttgactatatttaat

SEQ ID NO: 5942 - DNA, 138 bp, Zea mays
agtctgtccagatagccaaggatgacttgcctgtggcttcttggcttggcttggctcgggcaaaaccttgtgcacgttttattgctcgcctcgtggcctcgatcacaggcagtctccttggctagtccgggcgggccc

SEQ ID NO: 5943 - DNA, 219 bp, Zea mays
cggtagaatggacggctgagatcgcagaatggcagaacaccaaaaaaggcagggctactatagctaaacttaataagtagtaggagatatataatttttcagacaaatacccaatgcacataatcttgtttcagggtgtctcaaatgagaacaaaaaactgaaaagggatttggtgaaggactgttttgtacttttgtttctcaacttccaaagagctt

SEQ ID NO: 5944 - DNA, 206 bp, Zea mays
gcgaaggatgcggacgcccgcgtccgggtgaggcgggaggttcggtcgtcgcaagcaaggcaggtgggttttgttgacatagatctaggcaagcacgctgggtaagcggaggatgcggacgcccgcgtccggcgatggcgggacatcatgagagggcgggggaaccgcggcgtgcgtcgcggggatagggcggacgcaggggcggg

SEQ ID NO: 5945 - DNA, 71 bp, Zea mays
atagctcggcgccataggctgtggcgctgagctatgttagctcggcgccacaggctatggtgccgagctaa

SEQ ID NO: 5946 - DNA, 85 bp, Zea mays
ttggacccttagctcggcaccatagcctgtggcgccgagctaacatagctcagcgccacagcctatggcgccgagctatgacgtg

SEQ ID NO: 5947 - DNA, 141 bp, Zea mays
ggatttaagacctgtttggttcgtggctaactgcgccatactttgcctaaagttagtcgttcgaattgaagaactaaccttagacggaaaagttaggcaaagtatgacaagttaggtaacgaactaaacagacccttagac

SEQ ID NO: 5948 - DNA, 142 bp, Zea mays
gtctaagggtctgtttagttcgttacctaacttgtcatactttgcctaacttttccgtctaaggttagttcttcaattcgaacgactaactttaggcaaagtatggcgcagttagccacgaaccaaacaggtcttaaatcca

SEQ ID NO: 5949 - DNA, 114 bp, Zea mays
ttgcagccctcacaaaaatgaggatagactccacctgcaggtccaccagataacgttttagttgtgttattgatctgcgggtaggacctatccttatttttgtgaggggctata

SEQ ID NO: 5950 - DNA, 169 bp, Zea mays
tgatctaattcatcgtcttctcactcctcacttttttgtttggtttgtggaatggattgagttgattcatcatcacctcatttcttatagttatttagttagtactaatatgaggcatgaggtcatcccaccaaatttgaggaatggacccatgatgcaccaccacatt

SEQ ID NO: 5951 - DNA, 171 bp, Zea mays
cactacatacatcatgttcgaggacactcacacaacgtcagcaacgtccatcatcccagcgcacaagaattcatgtccggtcagtagcgactttacgtggcagttgggcttcaggtggacgatgagctggacggcgtgatggcgtcgtcgtcggatgcggtgtccagaaca

SEQ ID NO: 5952 - DNA, 118 bp, Zea mays
aggactttctagctcggcgccaagatctgtggcaccgagctaggagggcacgtccctagccgccgacgccacatcagagctcgatgctatagcctatgacgccgagttaagggtctaa

SEQ ID NO: 5953 - DNA, 100 bp, Zea mays
cttctccccctcctgcctcgatgccggcggcgaagcgcgccggatcgagggctcgagcccggaagaagcagtcgccagcgcggggtacgaatgcggggaa

SEQ ID NO: 5954 - DNA, 134 bp, Zea mays
actaggtagatgcccgtgcgttgcaacggtatataaaatattcaacaaaatgttagtgcataaaaaagaacacatatttcaattgcaccaaaaacgatacattccccgcttgcaaggttagggccgtattttct

SEQ ID NO: 5955 - DNA, 231 bp, Zea mays
  unsure (128)..(129)..(130)..(131)..(132)..(133)..(134)..(135)..(136)..(137): n = A, C, G or T
ctacgctcacagaggtggtaatggctctagattttatactacaaactttaaggatcgaatcggattacgatcggaccctagtattattcatttttcaactaaaattatttaaatcccttaatttttcnnnnnnnnnnttcttattcatttttgaactaaaattatttaagggccttaatttttctgaaaggacatttggatcgtgatccattaccacccctactcataccc

SEQ ID NO: 5956 - DNA, 111 bp, Zea mays
tgcagcccctcacaaaaatgaggataggtcccacctgcagaccaataacacaattaaaacgttatctggtggacctgcaggtggggtctatctcatttttgaatcgaattt

SEQ ID NO: 5957 - DNA, 253 bp, Zea mays
ataactgaaacgcctaaaaggctaatcgtgtgagtaaggacctagtaatttttctacctcctgcgaaagggcctctagcctagtggttaaggacttccgagtagctcctccaaatcctgggttcgattcccctcgggagcgaattttcaggcttggttaaaaaaatcacctcgctgtgtcctatccgctctcgggttacgatgtcctgtacgccaccctccggttggaccgttgcagagtggacagatgacgc

SEQ ID NO: 5958 - DNA, 96 bp, Zea mays
gttagaatttgttctaggcctccattccgaaacaaacgaacggccccttaggcttgttcgtttgtgccggattggtgggtcggaacgattcctaac

SEQ ID NO: 5959 - DNA, 144 bp, Zea mays
gttacttagggcctgtttggttcgtggctaactgtgccacactttgcctaaggttagtcgttcgaattgaagaactaaccttaggcagaaaagtgaggcaaagtgtggcaagttaggtagcgaaccaaacatgcccttattacg

SEQ ID NO: 5960 - DNA, 236 bp, Zea mays
caggttaggttggtgcacggttctgccataccccctcctccgcgattcgcgtctctgccgccatgcccgctctccatcgaaggaaggcgccattccagggattaccgcaccattctcgccctcgtccgctctccggcaccattccagcattccagggattaccgcctccccctcgatccgcggcactctcccccgtccttctcgagtatggcaccgccagtccgcctcgcgacccc

SEQ ID NO: 5961 - DNA, 136 bp, Zea mays
tttagggcatgtttggtttgctgcctaacttgccacactttgcctaacttttctgcctaaggttagttcttcaattcggacgactaaccttaggcaaagtgtggcacagttagccacgaaccaaacagacccttag

SEQ ID NO: 5962 - DNA, 150 bp, Zea mays
cacggaactaagggtctgtttggttcgtggctaactgtgccacactttgcctaaggttagtcgtccgaattgaagaactaaccttaggcagaaaagttaggcaaagtgtggcaagttaggcagcaaaccaaacatgccctaaatctcttg

SEQ ID NO: 5963 - DNA, 92 bp, Zea mays
ttacaatcacaggcggttttgtcttagggtccgcttgtgaaaaggatagagcatcacaggcggtcctaaacaaaaaccgtttgtgatactat

SEQ ID NO: 5964 - DNA, 102 bp, Zea mays
atctgatgaccggacgaaaccggtatgagcccggttcactatgtgtcgtgtcaggtttaggtcgaaccaaactcgtgctggatttcggaccgttcgttaaac

SEQ ID NO: 5965 - DNA, 144 bp, Zea mays
tagattaagggtatgtttagtttcctggctaacttgtcacactttgtctaacttttctgtctaaagttagttcttcaatttaaacgactaaccttaggcaaagtttgacgtagttagccacgaaccaaacatgctataaatcta

SEQ ID NO: 5966 - DNA, 93 bp, Zea mays
atctgaaacaatttcggatgtaatccggtataaacgaataaggccttagaccttgttcgtttgtgtcggattgcactcgaaatcgttttagct

SEQ ID NO: 5967 - DNA, 100 bp, Zea mays
gtccccacacgtggccgccgacgacgacggcgcgggcggggagaacctgaccgggcgcgtcgcgccctcattgtcgacgacgtcggccgcgaaccgcacc

SEQ ID NO: 5968 - DNA, 201 bp, Zea mays
taagaacgtgggtaccgtcgaacttaatgggcagccctcgctgactcacgcaggacccataagttcgacggccacgtggccccgtcaaacttaaatgtaagaacgtgggtgtcgtcgaacttatgggaaaaaatcgacggcccccgtcgaacttaaaaacccacgttcttaaccttaagttcgacggtacccacgttatta

SEQ ID NO: 5969 - DNA, 120 bp, Zea mays
gtttgcagtccctcacaaaaaggaggatagaccccacctgcaggtccaccaggtaacgttttagttgtgttattgacctgcgcatgaggtctatcctcttttttgtgaggggctgtaaag

SEQ ID NO: 5970 - DNA, 207 bp, Zea mays
aaaatatatgagcacttgaaccgcagcccgacttctgcatgggcactatatccctatttataggatcagctcggcgtacaacttctaaagaaattacatttatgtcccaagttctatacatacaacctatagagcccgtcgagggtattatggtaccttttctccttaagccatgttgggtatgctgctcaagttctcgttcgtctc

SEQ ID NO: 5971 - DNA, 72 bp, Zea mays
aaaattcaaacgggccaggctgaaattcaaacaattcggatcttttcgggcttgggccggactggacggccc

SEQ ID NO: 5972 - DNA, 192 bp, Zea mays
tagttagtgggtgtttggtttatagggactaaacattagtccctccactttattctattttagtttataaattgttaaataaggaaactaaaatagagttttagtttctatatttagtaaattagggactaaaatggaataaaattgagggactaaaaattagtccctagaaaccaaacaaccccttagttg

SEQ ID NO: 5973 - DNA, 143 bp, Zea mays
caattaaagggatgtttggtttctagggactaaaaattagtccctagaaacctagtttctgtatttggcaatttagggactaaaatgtaataaaatgaagggactaaaaattagtccctagaaaccaaacatcccctaagatc

SEQ ID NO: 5974 - DNA, 127 bp, Zea mays
atttagcttcctaagggccagtttggtaactctatttttctaaagaattctatttttctaagttcgttaaaaaatgaaatcctttttaaaagtaatgttgccaaactagccctagaggatgataatg

SEQ ID NO: 5975 - DNA, 68 bp, Zea mays
ctcttgtcggccggtcatgtgatgagtggcgccgatgtcgaggcaccatccttcgatcatgtctttgt

SEQ ID NO: 5976 - DNA, 150 bp, Zea mays
aaaaattattaggccttgttcgtttacatcggattgcacccggaatcattccggctaatcaaagtttatataaattagagaagcaatccggctcggattcgttccgacccatcaatccgacacaaacgaacaaggccttagtgtaattag

SEQ ID NO: 5977 - DNA, 140 bp, Zea mays
actaaaggtatgtttggtttgctgcctaacttgccacattttgtctaacttttctgtctaaggttagttcttcaatttagacgactaaacttaagcaaagtgtgcacaattagccacgaaccaaacaggctctaaagctg

SEQ ID NO: 5978 - DNA, 189 bp, Zea mays
tgccctccgtccgcgccagattggcctccacctgcgcagcctgcgccttggcgagggcctcgttggtctccctcctctcccccgccaattggcgccggaggtcagccttctccacctctagcgcggccaccttgtccgccagcttgcggcacttactgtcggcggccgatttttcacggacggcgtccg

SEQ ID NO: 5979 - DNA, 146 bp, Zea mays
ggtcgatgcctcctcgtgagacggcgggcgcagcgcgatcttccggcggcgctggtgaggggggataccgggataggcgagctggagctgaggcctggtgaagtgggatttgctgggactggccgactgggagagagggcggcccg

SEQ ID NO: 5980 - DNA, 175 bp, Zea mays
ttagcccctatcacatcgaatgtttgaacctccgttccgggtattaaatgtagtcggattataaaactaatttgtcagccgaagattaaaagacgagacgaatcaagtccagttggttgggtctatatttcatactcctatttgaaagtcaaacgcttgatgtgagccgggctaa

SEQ ID NO: 5981 - DNA, 222 bp, Zea mays
tgtttggttaccccaaactaaactttagcccctatcacatcgaatgtttgaacctccgttccgggtattaaatgtagtcggattataaaactaatttgtcagccgaagattaaaagacgagacgaatcaagtccagttggttgggtctatatttcatactcctatttgaaagtcaaacgcttgatgtgagccgggctaaactttagcaggggcaaccaaaca

SEQ ID NO: 5982 - DNA, 210 bp, Zea mays
gtagggttaagggcctgtttggtttgatgcctaacttgcaacactttgcctaacttttctgcctaaggttaggggcttatttggtttgtggctaactatgtcacactttgcctaaggttagtcgtccgaattgaataactaaacttaggcagacaagttaggcaaagtgtggcaagttaggcggggaaccaaacatgccctagttcttca

SEQ ID NO: 5983 - DNA, 166 bp, Zea mays
  unsure (1)..(2)..(3)..(4)..(5)..(6)..(7)..(8): n = A, C, G or T
nnnnnnnnaggtctgtgttcttggagtgtgctatggagttacagaaagtctgtaacactcatgcaagagactctgtttgagacatttgttagagttgctctaacactcatattttgtcaaatattttgtacgccgttgcaacgcacgggcacatacctagttacaa

SEQ ID NO: 5984 - DNA, 253 bp, Zea mays
agaaatccatagcgggagagcaagcagaccggggggaaggacacgagaagcagaagaacctgagctaggccatcccctggccggggagggtgggttcttcgcagagatttgcttcccgcattccgtagcttgcttcttctcgattgcgagttggatcgcagagacggagcgtttagggggctactccctctggcggagcacgtttgatctgcgtgggtgcctgccgtcttcttcctctccaccaatctactgc

SEQ ID NO: 5985 - DNA, 144 bp, Zea mays
tgtatttcgggcatgtttggtttgatgactaagtcgccatattttgtctaacttttctgcccaagattagttcttcaattcagacgactaaccttaggcaaagtgtgacacggttagccacgaaccaaacaagcccttcatgtc

SEQ ID NO: 5986 - DNA, 181 bp, Zea mays
aatttggtgcagccggctgcaaaccaggatacttacagcctctcacataaaaaaaattgagcctatctacagcagcaataacataactaaaacgttatctattggacctgcaggtagggtcaatcctccttttttatgaggggctgcaaatattctgatttgcagccgactgcaccaattt

SEQ ID NO: 5987 - DNA, 89 bp, Zea mays
agctggcccaggcggcgtagtcggggttgcccatgacggtccacccaatcgtgccgcccacctcgtacacggccgccgacgccacgccc

SEQ ID NO: 5988 - DNA, 163 bp, Zea mays
gatggctatagggggtgtttggtttctaaggactaatatttagtcccttcattttattccttttaagttttagtttctatatttggtaattttggaactaaaatggaataaaatgtagggactaaacattagtccctacaaaccaaacaccccaatagttgca

SEQ ID NO: 5989 - DNA, 138 bp, Zea mays
agtttggaaaccacaaaaccggagaggattgaggagctagaatcccttctttttagaatcccgttcttatttaaatttgaataaaaagaaaattctagcccctccaatcccctccggttttgtggctcccaaattagc

SEQ ID NO: 5990 - DNA, 141 bp, Zea mays
gctaatttgggagccacaaaaccggaggggattggaggggctagaattttctttttattcaaatttaaataagaacgggattctaaaaagaagggattctagctcctcaatcctctccggttttgtggtttccaaactagc

SEQ ID NO: 5991 - DNA, 115 bp, Zea mays
ccacaaaaccggaggggattggaggggctagaattttctttttattcaaatttaaataagaacgggattctaaaaagaagggattctagctcctcaatcctctccggttttgtgg

SEQ ID NO: 5992 - DNA, 249 bp, Zea mays
cagggtgttacatgtgtttggaatggctccaggttccagctccagtgtggagttgtagtttataatatcattttaattagttttaaaaatatttttaatctaaataataaacaaattggcttatctaaatatcttctaaaggcttattgctctaactctacaattttttagagcgtttaatggcctgctcctctaactctaccaaatttaatagagctggagctatcccaaacagtgcctaaaaataca

SEQ ID NO: 5993 - DNA, 140 bp, Zea mays
atatccttaaggactgatttggtgacccgggatcccgagaagaagaaatcctcttgctattcaaaattgaactacaagggaatttctcccccatggttccccttgggatccctaatcaccaaatcagccctaaggtatgt

SEQ ID NO: 5994 - DNA, 104 bp, Zea mays
cttggtctataagggctgatttggtgacccgaaaaatagaggtgattccttctccatgtatcccctttattttcctggtcatcaaaccaactctaagagctagt

SEQ ID NO: 5995 - DNA, 93 bp, Zea mays
ccgtatcctaccctaatgtatttatctcggatacgggaccggatacgggtagttaagattcgggacggatacaggacgggaccgggtaataat

SEQ ID NO: 5996 - DNA, 160 bp, Zea mays
  unsure (41)..(42)..(43)..(44)..(45)..(46)..(47)..(48)..(49)..(50): n = A, C, G or T
gaggagagcgggagatgaagggcgtcgggggcggcgcggtnnnnnnnnnntttgcctccccgggggactatgtctacttcaatctgtcgtcccgctccacaagatctccgtgagttcgcgcgcgcctcgcctccctccctcccatctcactgcagtctct

SEQ ID NO: 5997 - DNA, 148 bp, Zea mays
tatgtatttagggcctgtttggtttgatgactaacttgccacactttgcctaacttttctgcctaaggttagttattcaattcgaatgactaaccttaggcaaagtgtggcaggtttagccacgaaccaaacagccccttagatttaa

SEQ ID NO: 5998 - DNA, 141 bp, Zea mays
gcttttaagacctgtttggttcgtggctataactgtgccacactttgcctaaggttagtcgtccgaattgaaaaactaaccttaggcacaaaaattaggcaaagtgtggcaagttaggcagcgaaccaaacatgcccttag

SEQ ID NO: 5999 - DNA, 154 bp, Zea mays
atctccgacggctgtctacgatgccgtcggacatagcgttatgtccgacggccaccaagcactctcggaaatatcgccttatctccgacggctaccctgacagccgtcggacataagcttatgtccgacggcctcgtacgtagccgtcggaggt

SEQ ID NO: 6000 - DNA, 145 bp, Zea mays
ttgctgccgccgctggccgccttctccgccgccttcttgggcaggagcacgtggcgcgggatgatgcgcgtcttcttgttgtctttcgccgcgttccctgccaactccagaacctcggcggcgaggtactccaggacggcggcga

SEQ ID NO: 6001 - DNA, 118 bp, Zea mays
ttcagcgtcacagatcttggcgccgaggtgttggccccgatgacgtagatggatcgagctggcagctcacgtggtctagttttgtgttagaccttggcgccgaggtctaggtctgtga

SEQ ID NO: 6002 - DNA, 75 bp, Zea mays
tctgctttgtctcgcgagctaaacgagccgagctagactaactctgtggctcattagctaaagggatttcccttt

SEQ ID NO: 6003 - DNA, 148 bp, Zea mays
actgcacttagggcctgtttggtttgatggctaacttgccacactttgcctaacttttgtgcctaaggttagttcttcaattcgaacgactaaccttaggcaaagtgtggcacatttagccacgaaccaaacagccccttagtgcatg

SEQ ID NO: 6004 - DNA, 158 bp, Zea mays
ctgtgcatgcactaaggggctgtttggttcgtggctaaatgtgccacactttgcctaaggttagtcgttcgaattgaagaactaaccttaggcacaaaagttaggcaaagtgtggcaagttagccatcaaaccaaacaggccctaagtgcagtttata

SEQ ID NO: 6005 - DNA, 189 bp, Zea mays
ttgcgtctcaactgctgacgggagggaagggagcggatctagtgatccatggtaacgtagttctcaacagtaccatgtagcaagcatcctggcatgctcctcttggtctcctggtctgatagactgacaattgtggggtaaggggggtcggggtggtctcctggtctcttcggtcatcgtctgagaggg

SEQ ID NO: 6006 - DNA, 149 bp, Zea mays
gtctaaggccagggtctgtttggttcgtgactaactatgtcacactttgcgtaaggttagtcgttcgaatttacgaactaaccttagacacaaaagttagataaaatatagcaagttagacagcgaatcaaacatatctactacctgca

SEQ ID NO: 6007 - DNA, 74 bp, Zea mays
gtcatccgttgcaacgcacgggcatatacttagttattctactaggtgagtgcccgtgcgatgcgatgggagta

SEQ ID NO: 6008 - DNA, 229 bp, Zea mays
ccgccccattgcccacacgacgacagttctcagctcgtctaacgcttagccgctgaagccattggagaggcgatatgggaagcccccggtgacgatgcggctaccgcagcacacggagcgtgcgggttcgccgaaaacctgcagcatcttccaagcgtggctgccccgtcaccttcgctgtcccggtcctgtctcgcagctgctggtcctgtgcgctgtccctggatgc

SEQ ID NO: 6009 - DNA, 148 bp, Zea mays
agaagagtgcgggcctgtttggtttgtgcctaaatatgtcacactttgcctaaggttagtcgttcgaattgaataactaaccttaggcagaaagtttaagcaaattgtgacaactgaggtagtgaaccaaacatgcctgtagtctctc

SEQ ID NO: 6010 - DNA, 163 bp, Zea mays
gcatgcgcaccagcagcgggtccatcagaccgcaggttcattagaaaatgtataagaggagttttttttttgtgcaaaagcggtgaccgtggaacctttaaatcatgtaaactagtgatttataataatactaggtgagtgcccgtgcgttgcagcgggaaca

SEQ ID NO: 6011 - DNA, 221 bp, Zea mays
acggtagaatggacggctgagatcgcagaatggcagaacaccaaaaaaggcagggctactatagctaaacttaataagtagtaggagatatataatttttcagacaaatacccaatgcacataatcttgtttcagggtgtctcaaatgagaacaaaaaactgaaaagggatttggtgaaggactgttttgtacttttgtttctcaacttccaaagagcttt

SEQ ID NO: 6012 - DNA, 113 bp, Zea mays
actaggctgttaggaggggacgggggaggtcaaacccaacgtacatcatgagtggagctgctgtaatgtaacagaagtattgcaccccccccccccccccccaataatatata

SEQ ID NO: 6013 - DNA, 103 bp, Zea mays
tgttttcaaacaaagatccctcggtgctccgctgtactcaggaatttagtagagaattacgactgatcattcatagagcgcggggggaatttgacacctcaat

SEQ ID NO: 6014 - DNA, 160 bp, Zea mays
agccgcgaaagatgtagggcatgtttggttccctgcctaacttgtcacactttgtctaacttttctgcctaaggttagttcttcaatttaaacgactaaccttagtcaaagtgtggcgtagttagccacgaaccaaacaggcccataaccttccgcactc

SEQ ID NO: 6015 - DNA, 149 bp, Zea mays
cggaaggttatgggcctgtttggttcgtggctaactacgccacactttgactaaggttagtcgtttaaattgaagaactaaccttaggcagaaaagttagacaaagtgtgacaagttaggcagggaaccaaacatgccctacatctttc

SEQ ID NO: 6016 - DNA, 198 bp, Zea mays
tcggagccgcgggtggggagcccgggcccggcctcgagcgcctcgagctccgggtcgaccatgggggagaggaagccgatgaggaggttgagcaggtagatgcccagcccgtaggtgacgacgtagaagccgcgcacgtagtagacccgaagcgcgtacaccgccgcggccacgagcgtgcccgcccaccgccccgcc

SEQ ID NO: 6017 - DNA, 118 bp, Zea mays
aattcatcttaagggctgatttggtgactagaaattatagaggatttatgggggaggaatctcttgctatttaatttttctccaattccttagcaccaaaccagccctaacctaacag

SEQ ID NO: 6018 - DNA, 126 bp, Zea mays
cttgggaagccccccaaggcaggcatgggccaaccgggctctgataccagatgtcagtgtccaacccccggcacagcccacactcgatagcttcggtcgttcatgcctgccttgggacactcgcat

SEQ ID NO: 6019 - DNA, 85 bp, Zea mays
agatctaggccgagtctcaaattccgacccgtcgggccctcaacatggcccgcatagatgagtcgggtttgagacaatacaaccc

SEQ ID NO: 6020 - DNA, 73 bp, Zea mays
cgtcgtccgcgtggtccggcggcaggaaccgcgcccaggcggcgtcggagtccgcagcgggcctgaagggcgc

SEQ ID NO: 6021 - DNA, 155 bp, Zea mays
gcaagagaatctagggcacgtttggttcgttaccccaattatcacactttacctaacttttcagtataaggttaattattcaattcgaacgactaaccttaagcaaagtggggcacagttagccacaaaccaaacaagccctagtctctctaatt

SEQ ID NO: 6022 - DNA, 223 bp, Zea mays
cgccttgcatcttgggccagattggagtttccagcatttgtttaagaaactgttagagtatacactataatttacctctaaaaatttttagcctatccctaataatattttttggggatatttttagcttcctcttggagttgctcccaagtgactccaacgtgccgtctatataaagcaccctactctctatcgccacttcactcgggtccatagttcaaaa

SEQ ID NO: 6023 - DNA, 84 bp, Zea mays
gggcgcacagaccaacgacctccgggccgaactcaaccgcaggcgcgcgggagaggacgcccggatctctttggaaagggcgcg

SEQ ID NO: 6024 - DNA, 248 bp, Zea mays
gaacgcttagggggtgtttgggatagctacaggttctagctccagtgtggagctatagtttataatatcaatttaaatagtttaaaaacagttttaatctaaataatatataaaatgacttatctaaatgtgttttaaaggctcacagctccagctccacgattttctggagcacctaatgacttggtccacgaacaccaccaaattttctggagatggagctatcccaaacagagccttaggagcag

SEQ ID NO: 6025 - DNA, 82 bp, Zea mays
cgccgccgcctccatgaaccggtgaccggagctggacggtgttgactctggcagagcggttgaggtcgtgggggggggggga

SEQ ID NO: 6026 - DNA, 69 bp, Zea mays
gtgcagttgtgtcactgcacgtgggacccagtcctgctcagtcccgcgtgtcagtgacccatccacaaa

SEQ ID NO: 6027 - DNA, 200 bp, Zea mays
ggcccttcgaacttgggtgccgtttggtcacaaaatgtaacgtaaatgataacgataatggttcgagtttgtataggccggtattaatttctagtatattatttgattacggtgcacttaaacaaacatattttaacgttatctgttacccattatattaaaaatatgtgaaccaaacagcacgctaagtttggttctat

SEQ ID NO: 6028 - DNA, 96 bp, Zea mays
aactcattaccggaatcgcgttctttgccgagtgtctaagacactcggcaaaggctattttacactcggcaaagagctaaattccgatagtgacta

SEQ ID NO: 6029 - DNA, 179 bp, Zea mays
aactagctctaagggctgatttggtgaccagaaatcacggtcaccagagagttggaggggattgaggggtgatctcattatcaccaaatcatctctagagagaattggagaggattgaggagaaatctcttcaatcttctcgtgatctccttgtcaccaaatcatctctaaggtagatc

SEQ ID NO: 6030 - DNA, 128 bp, Zea mays
gccgtgcggaggcgggtctgtcggcgtagagctcgcaccccttggaaccgaggccgcgcgaccccccgcaaccgaagatccaaggcagcttccccctgttcgtcgccggagagtcgccatcggcaaaa

SEQ ID NO: 6031 - DNA, 91 bp, Zea mays
tcgttcgagtgagtcgggcttccgaattcggattcgcgcgagcgatgaattttaaataatcaccggacgcaccgattttcagaataaatat

SEQ ID NO: 6032 - DNA, 134 bp, Zea mays
ctcaggccttgttcgtttccgtcggattgcacccggaatcgttccagctaatcaaagtttatataaattagagaagcaatccggctaggaatcattccaacctatcaatccggtagaaacgaacaaggcctcaa

SEQ ID NO: 6033 - DNA, 84 bp, Zea mays
atcatggctcccgacgaagcaggggctgcgaccagcgcactggacgttgctgggaccgcctgatgctggcgtcggctgttgcct

SEQ ID NO: 6034 - DNA, 190 bp, Zea mays
atcgaaatatagggctctacacaggaaaaaccactccaacagtgcctcaattcaacaaattttgtcaaaaaactatagggcaccctctcaagtgcctcaaatatactacaccgtagtgggctgccctataatctagatttggggctttactgttggagcggggtgttttgttggtgccctaaattctata

SEQ ID NO: 6035 - DNA, 91 bp, Zea mays
agccttggacgcctgctgcaccagagatcataccgtgctggttcggggacacatggccgaagaactgctgctgctgctggtgggcttggtg

SEQ ID NO: 6036 - DNA, 95 bp, Zea mays
cgacggctttaagccgtcggagataaggcttgaccgtcggaaataatctatttccgacggtttattccttatgtccgacggctttggccgtcgga

SEQ ID NO: 6037 - DNA, 119 bp, Zea mays
gtttgcagcccctcacaaaaaggaggataaatctaacctgcaggctaataacacaactaaaatgttatctggtggatctatagataggatctatctttatttttgtgagaggctgcaaa

SEQ ID NO: 6038 - DNA, 148 bp, Zea mays
ctgcaaaccagactgtttgcagcctctcacaaaaataaagatagatcctatctatagatccaccagataacattttagttgtgttattagcctgcaggttagatttatcctcctttttgtgaggggctgcaaacagcctgctttgcag

SEQ ID NO: 6039 - DNA, 152 bp, Zea mays
gcctgcaaagcaggctgtttgcagcccctcacaaaaaggaggataaatctaacctgcaggctaataacacaactaaaatgttatctggtggatctatagataggatctatctttatttttgtgagaggctgcaaacagtctggtttgcagcg

SEQ ID NO: 6040 - DNA, 131 bp, Zea mays
  unsure (123)..(124)..(125)..(126)..(127)..(128)..(129)..(130)..(131): n = A, C, G or T
ttaggccttgttcgtttgcgtcggattgcacccggaatcattccggctaatcaaagtttatataaattagagaagcaatccggccgagaattatccgacccaccaatccgacacaaacgaacnnnnnnnnn

SEQ ID NO: 6041 - DNA, 134 bp, Zea mays
ttaaggccttgttcgtttccgtcggattggtggatcggaacgattcctagccggatcgcttctctaatttatataaactttgatgagctggaacgattccgggtgcaatccgacgtaaacgaacaaggcctaag

SEQ ID NO: 6042 - DNA, 95 bp, Zea mays
gaaacaatccaaacttggaacggttctgggccacccttagggcccgttcggttgacggggaatagaaggccggaattgttccggtccggattgtt

SEQ ID NO: 6043 - DNA, 75 bp, Zea mays
atgtatgtaagggggtgtttggtttctatgaactaaaaattagtctatagaaaccaaacacctctaagtgagaac

SEQ ID NO: 6044 - DNA, 81 bp, Zea mays
ccaggaactgatgacagcctaggcgagaatacggtgtgatccccacgcctgtgctcgtgccacgtgctgcttgcttccgtg

SEQ ID NO: 6045 - DNA, 133 bp, Zea mays
atccccccgcagtcgcaacgggagcaccgcacacgatgagactggagtagaagtcgaaggtaggagctgacgggttgaaatcccccgcagtcgcaacgtcgtgagggtgcgaatgttgcggttggattagaga

SEQ ID NO: 6046 - DNA, 98 bp, Zea mays
  unsure (89): n = A, C, G or T
tataccagctgctggtccatgtaaatagaataaaaacaaattactaaagagttattttgtaaattttgatctgtgtttgtgggcctccnagtgatgga

SEQ ID NO: 6047 - DNA, 77 bp, Zea mays
cgccgctatgatctacgtagccgagggccggccactctatcccccaacgcccttgacaacctggtatcatgatccaa

SEQ ID NO: 6048 - DNA, 106 bp, Zea mays
ttgattagctggaacgattccgggtgcaatccggcaccaacgaacaagccctaaggctctgtttggttgtccgggattctatccaagaatcgttccagctgatcaa

SEQ ID NO: 6049 - DNA, 86 bp, Zea mays
tccgctctctggttacgatgtcctatgcgccaccctccggttggaccgttgcacagtggacggttgacgtcgggccgttagtgatg

SEQ ID NO: 6050 - DNA, 103 bp, Zea mays
tgttttcaaacaaagatccctcggtgctttgatgtacgcaggaattcagcagagaaatgcgactgatcattcacagagcacgagggaaatttgacacctctat

SEQ ID NO: 6051 - DNA, 80 bp, Zea mays
cccaaaacctcccctccctccctccctcccacccagatcgcaggtcggagagcgcgtgggacgggaggggagcacgcgga

SEQ ID NO: 6052 - DNA, 126 bp, Zea mays
aatagaatgtgacggtgacggtgacggcgactggtgcccgcgctggattagaaatttcagtggtcgccaccgcacgcgtatttgattgcgagttttgtcgtcagccagtcatggtcatggccggtt

SEQ ID NO: 6053 - DNA, 142 bp, Zea mays
gagctcactgagggctgatttggtgaccggggatcccgaggggaagaaatcctcttgctattcaaaattgaattgcgaggggattcctcccccatggatcccctagggatccctagtcaccaaattagccctgaagtggatt

SEQ ID NO: 6054 - DNA, 232 bp, Zea mays
aataagtgaatgtccgtgcgttgcgacgggagtaaaaaaaatgtatgaaatatataaatggaacgacaaatatcgctataatatgtaaaatccatgtggtaaacattatcaatattacacaaattatttctaaagagtcaatttagaattttgtaataacacacaaatatgtcgacaatcatacactaatctaatcctttttaccacgacgtagcgacgacaagcacgacag

SEQ ID NO: 6055 - DNA, 248 bp, Zea mays
agcaccatctgggtcccgctctggctgattggtctcaaccaaagtttttctcgaacagcttgatgtattggatactgttgtattcgaaaactaaagcattgtaaactgtagtaatgtcatgactaaagtataatttagtatttaaaaaactgcagtttagaaaaactgtattcccaaacagggcctcatttgcttttagtggcagagctcttgtaaggctgtctccagcagcgtcccctaaatttcgt

SEQ ID NO: 6056 - DNA, 216 bp, Zea mays
gcaatcagaccttatgtgcaagcgttcaagcgaggttcatggtccgttagatcatgatccaactgtagacataatcatggtttgttaggggtttttctataaatctacacaagctgatggtggaagagtttaagtgttaaatgtgatatatggttggatcataatctaacggacaatgtatctcgcttgcacgcttgcacataagacatgattgca

SEQ ID NO: 6057 - DNA, 171 bp, Zea mays
tttagttgcaataacaggacgggatgagacgatccctcaaataagattattgaattagagtcaaggattgatacaagactattccagtgttgtccccaattatccctcaaaattggtgcaacgaaatacagatactagagacatccctgtcctggttgtcccgcaaccaaa

SEQ ID NO: 6058 - DNA, 157 bp, Zea mays
ggatatcatagttagggcatgtttggtttgtggctaaatgtgccacactttgcctaaggttagccgttcgaattgaataactaaccttagacagaaaagttaggcaaaatgtggcaactgaggtagtgaaccaaacaggccctttcgaattgaataa

SEQ ID NO: 6059 - DNA, 212 bp, Zea mays
atccgaagcggatcacggaccacgtcgcaagaaagcggtcgattctcgtagcctttaccacgtaccccttcgcattcgcattgtcaatcgcacgcctcgccccgcgaccgctagggtttcccctatatctccccgagcgcactaccaaagtcccaaaacatcttctatacgtgccgagtcaggtgactggtccagtgctcaccgaacctgtt

SEQ ID NO: 6060 - DNA, 164 bp, Zea mays
gagccaggtccagcgcaccacgtacaggtctgcgtaggggtccttcttctcgtcccccgcgggctgcttcgacgtcagcttgaacgagatgtcccgcctgaacaccaccttcaccagcacctggcacaccgcggccaggtacgcggagcagctggccgtcatcc

SEQ ID NO: 6061 - DNA, 152 bp, Zea mays
ttcgtttgtgtcggattgatgggtcggaacgaatccgagctggattgcttctctaatttatataaactttgattagccggaatgattccgggttaattagagaagcaatccggtccggaatcgttccgacccaccaatccagcagaaacgaa

SEQ ID NO: 6062 - DNA, 104 bp, Zea mays
cggaacgaatccgagctggattgcttctctaatttatataaactttgattagccggaatgattccgggttaattagagaagcaatccggtccggaatcgttccg

SEQ ID NO: 6063 - DNA, 88 bp, Zea mays
ccttgttggagcagcggctgctggctccggctgccctcaggccgcgcgcggcgcagcagccggggccgggcgccgttgacgatacacc

SEQ ID NO: 6064 - DNA, 184 bp, Zea mays
gtgattaaggatgtttggtttctatggactaatgtttagttcctatattttattttagtatctaaatagttaaatatggaaactaaaattatttagtttccgtatttaacaatttaaggactaaaatagaataaaataaaggagttaaagattagtccctagaaaccaaatactccttaaatca

SEQ ID NO: 6065 - DNA, 70 bp, Zea mays
gccaaagctattctgaaaaatcatttggcaaaacggcttataggttgtttttcagaaagacccttgtata

SEQ ID NO: 6066 - DNA, 79 bp, Zea mays
tagaaccgaagaaccgaaccgaagaaccgagaaccgaactagtcggttctagtttctttgttttgctatttcggttcta

SEQ ID NO: 6067 - DNA, 88 bp, Zea mays
aatgatactatcggacggttggactgggcaaaaagaatcggaaccgaggaaccgaaaccgaactaaccgaaccgaggaaccgttatga

SEQ ID NO: 6068 - DNA, 149 bp, Zea mays
tatattccttcaggccttgttcgtttgtaccggattggtgggtcgaaacgattactaaccggattgcttctttaatttatataaactttgattaggtagaacgattccggatgcaatccaacacaaaagaacaaggtctcagtgttgtt

SEQ ID NO: 6069 - DNA, 117 bp, Zea mays
ctcatgatccgtagcagtgcttgcgtgctagtccattgagttatacatggaaggattctgtcctctcttttgtttgtagatattgtggtggtattaagtatttgttgtgcttatatt

SEQ ID NO: 6070 - DNA, 116 bp, Zea mays
tggcggaaatagacgaccgacggcggcgtctttgcacggatcgaccgggtcgccgctccgcgaagctgcccagtggatccgcgtggacgacggcgtctgctggtcgccgcccggag

SEQ ID NO: 6071 - DNA, 146 bp, Zea mays
ttttttcaagaatttagggtgcgtttggttgtaataacagaacgagatgggataggactatcccttaaataaggttgtttgagtgatcgtcacgtctcatcctgtcctgtcattgcaaccaaacgcaccctaagttaaattattcg

SEQ ID NO: 6072 - DNA, 116 bp, Zea mays
tcatagtatatgacgctgacgtaacacgactcggcatcatagactatgacgccgagatacgtgctacgcaacacgtatggcgccgagctgtgttacctcggcgccatagactatga

SEQ ID NO: 6073 - DNA, 126 bp, Zea mays
tctatgccgtgccagaaattgtgtgctttgggccggcgtattaggcacagcacaaatgtacacctatataatccgtatgaaacggagttccgagcacgaggcacactgttctgtgcttgctaaaat

SEQ ID NO: 6074 - DNA, 91 bp, Zea mays
gcgaagtcacgcatcgttcacgtgggcgagaggttgtgcgctgtccagacaccggttaccaccagccacgcgccacgatgccaggccacag

SEQ ID NO: 6075 - DNA, 108 bp, Zea mays
gggaacaattagggctgatttggtgacccgggaggattggaggggattgaggaggaaattagtttatttgaaccgcatgcggttccaaaatcaaaatcaacgacatgt

SEQ ID NO: 6076 - DNA, 176 bp, Zea mays
ctagtctggaagccacaaaactggagatgattgatgattgtaggggctaaaatctctgtcttattaaaaaattggataagaaagagattttagcacctccagtcccctccggttttgtggctatcaaactagcctataacgtgtgtcccctccggttttgtggctatcaaactagc

SEQ ID NO: 6077 - DNA, 194 bp, Zea mays
gccgagcgccgccttcaccgagtgtttggcactcggcaaagatacctttgtcgagtgtaattctttgccgagagtcctgctctcggtaaaagttttcgttaccgagagctatactttgccgagtgcggcactcgacaaaagtttctttgccgagtgcccgataaaaagcactcggcaaagcgccgagcactcgg

SEQ ID NO: 6078 - DNA, 147 bp, Zea mays
agatatttttcacgggtacgggtttgggacggtaaaacccagcgggtttgtaaccgttgccatctctagtcctgtccactcgcgccgggctggacgaagacccggtggcctgctggccttcccagccacgtacgcgtctcatcctca

SEQ ID NO: 6079 - DNA, 239 bp, Zea mays
gatttgaggtgagagaggagagcggaggagagacttatagcggtggtggaggagaggaagggggggttaaaaagggtggcaatggcgagagcgggtggtggagcggcaacaaggaataaaactcggcgcagtcaccagtcagggacgagcgctttgactgtccggtgtccgcgcaggcagccgccccgcccctcgtctttacaagactgccttttgtttttgtttccgccgtgacgtga

SEQ ID NO: 6080 - DNA, 145 bp, Zea mays
tcatggcggcgctcacaaggtgccacggcccgctgcagctgtctatccccaaggaaggcggcaacgagggggagcctcggcaaggggtttgggttccccctccccttcgatcggtcgagagcaaccaagtgaagcgccatcaccg

SEQ ID NO: 6081 - DNA, 164 bp, Zea mays
gagccaggtccagcgcaccacgtacaggtcggcgtaggggtccttcttctcgtcccccgcgggctgcttcgacgtcagcttgaacgagatgtcccgccggaacaccaccttcaccagcacctggcacacggcggccaggtacgcggagcagctggccgtcatcc

SEQ ID NO: 6082 - DNA, 89 bp, Zea mays
ccttggtggagcagcggctgctggctcccaccgccctcaggccgcgcgcggcgccgccaccgggaccgggcgccgttgtcgatacaccg

SEQ ID NO: 6083 - DNA, 202 bp, Zea mays
gtggattggtaggcaggcaggcaggcagacacgatggcttggggaagggggtgtacaaggcaacggattccgatggttaacgactacagtctagaaaattaaaaatattcccgttccgttaggtttattaataaccgtattatcattgctcgatagtgataggtcaaacttcgccccgccagctcaggctgcagaccggttc

SEQ ID NO: 6084 - DNA, 102 bp, Zea mays
taacgtcacacccggtctaaggtgcggcgaccgattcggccgccacaactgcggccaacggccgattcggccaccacaactgcggcgcgggaagtgtggcgt

SEQ ID NO: 6085 - DNA, 212 bp, Zea mays
gttgctcttagggggtgtttggtttctagagactaatttttagtcccttaattttagtttctaaattgacaaacataaagacttcaaagtgtttgatttatagagactaatttttattccctccattttagtttctaaattgacaaacataaagactaaaatgaatggactaaaaattagtctctaaaaaccaaacatccccttattctata

SEQ ID NO: 6086 - DNA, 97 bp, Zea mays
gcggcgggggcgggcggttcgcgcggcgggattcgccgcgggcgttgccggttgtgggaggggatttgcgtcgtgcgggctgctcgagcgggggcaa

SEQ ID NO: 6087 - DNA, 149 bp, Zea mays
ccgtctctctcaggccttgttcgtttgggtcgaattgcacccggaatcgttccaggtaatcaaagtttatataaattagagaagcaatctggctagtaatcgttccgacccatcaatctggcacaaacgaacaaggcctcaatgagatc

SEQ ID NO: 6088 - DNA, 125 bp, Zea mays
gacacatgtcctggcacgtgacccgaaccggcacggcccgaggcaacagcgtgccgggccaggcacgaccctgttcgtgccgtgcctaaccgggctcgggccgggtccgtgccgggcggcccgga

SEQ ID NO: 6089 - DNA, 99 bp, Zea mays
gacccggctcgacttttctggcaagtcgggcgacttgtcaacgactggaaattctcagtcgactagtcgtcgacttggtctggcaagtcgaccgacttg

SEQ ID NO: 6090 - DNA, 134 bp, Zea mays
ttagtcctttgttcgtttccgtcggattataactggaatcgttccagctaatcaaagtttatataaattagagaaacaatccggtcaggaatcgttccgacctaccaatccggcagaaacgaacaaggccttag

SEQ ID NO: 6091 - DNA, 74 bp, Zea mays
gaaatttcaggtccgccgccacgcgtcacgagacggatggtgccgaggccgtggaatgcggacgggcgcccaaa

SEQ ID NO: 6092 - DNA, 103 bp, Zea mays
catcgtcgtaggcttctagcaggtcttcaagtccttcatctgaaagggatgaaggaggaccaatgatgtcctgagggctagtttgggagccacaaaaccggag

SEQ ID NO: 6093 - DNA, 198 bp, Zea mays
ctaatttttagggggtgtttggtttctaagaactaatgtttagtctcttcattttattctttttagtctataaattgctaaatatagaaactaaaataaagttttattttctatatctgggaattttggaactaaaatgaaataaaatatagggactaaacattagtccctagaaaccaaacacccccttagtctctc

SEQ ID NO: 6094 - DNA, 165 bp, Zea mays
tgagctagtccatcatcttctcactcctcacttttttgtttggtttgtggaacggaatgagtcaatccatcatcacctcattacttatagttagttagtactaatatgaggaatggggtcatcccaccaaatttgaggaatggacccatgatgtaccaacatatt

SEQ ID NO: 6095 - DNA, 138 bp, Zea mays
gctttagggcatgtttggtttgtggctaactgtgccacactttgtctaaagttagtcgtttgaattgaataactaaccttagtcagaaaagttatgcaaagtggggcaagttaggcatcaatcaaacagacccggtgg

SEQ ID NO: 6096 - DNA, 148 bp, Zea mays
ggcctgcgcctgcgggatctctgtcgcgtcgtccgccgccagaggctttcggccgccgcctccttcaacgatccgccgtccgccagaggcggatctccctccttcaacggccgccgccaggggcagagatccgcgccaggagctgcgc

SEQ ID NO: 6097 - DNA, 115 bp, Zea mays
gcgttattagcctcaagtcaagaatgtgttcactaggaaccatacccttcaagtatttccaactgctggctggtgaccctgtgtagcaacttcttaagttgtgggccatcctgct

SEQ ID NO: 6098 - DNA, 125 bp, Zea mays
agcacacgataagggctgatttggtgatcagagattataaaggggagaaatcctcttgcaaatcaattttgaataacaaggggattcatttcttatggatcaccaaatcagctctaataggatga

SEQ ID NO: 6099 - DNA, 77 bp, Zea mays
ttgcataggtggtggtcatggttgaataatgagcatgaactcaacaccttcagccttgaccaacctctccttattct

SEQ ID NO: 6100 - DNA, 103 bp, Zea mays
tgctggtcaaattaacttcctagaggcttattaagccgtaggaagttagccagctaacttcctaggggctacagtcagccgtaggaagttagtcagctgacga

SEQ ID NO: 6101 - DNA, 199 bp, Zea mays
aaaagagttagggggtgtttggtttctatggactaatgtttaatccctttattttattccattttagtttataaattgtcaaatataaaaactaaaatagagttttagtttctgtatttagtaattttggaattaaaatggaataaaatatagagactaaaaattagtcctagaaaccaaacaacctcttagtcgtttt

SEQ ID NO: 6102 - DNA, 153 bp, Zea mays
tagacttgctcgacagggacttggtcgttcactctgcctctcggacttgctcggtagggacttggtcgtccgctttgcctcgcagacttgttcgacagggatttgctccgtctcgtagatttgctcgacagggacttggtcgttcgctccacc

SEQ ID NO: 6103 - DNA, 123 bp, Zea mays
ttatttataggtgactgcctgtgcgttgcaacaggaacatatataggtagattaggataacaaaatttaagataacaatatatatgttcttgttgcaacgcacgggcactcacctagtatatt

SEQ ID NO: 6104 - DNA, 168 bp, Zea mays
aagatgagggggtgtttggtttttagggactaatttttagttcctctatcttattctattttagttcatataaattgttaaatacggaaagttttcgtattggcaatttagggactaaaataaagtggctaaaaattagtccctagaaaccaaacactttctagtaat

SEQ ID NO: 6105 - DNA, 177 bp, Zea mays
aattgacaaggtgagtgtccctgcgtcacaggtccaagtttctcttcgatatcatcccggacagctcgcatatatgtcatcccctatctcataactatataacacatatgtgcatatataagttatcgagatagtatatgtcctcgttgcaacgcacgggcactgacctagtataca

SEQ ID NO: 6106 - DNA, 80 bp, Zea mays
tcgttgtgtcccgcccgccttgggttatgtcctgcgccaccctccggctgggccattgcagagtgggcggtgacggcccg

SEQ ID NO: 6107 - DNA, 252 bp, Zea mays
atttagcgagaaccactgcgggagataaaaaaagtatggaataaactgttaatgatgtgacgcaaaaaaagtgatatagagagagaaatttagagggaaccgcttctgatagtctgattccctcgtttagaagtggtgtacattgaattctcgccttacttcactttgaggctatccgcaaccgttacccctaaatttttctccctatatcacttttccccctattttttcatctcccgcagcggttccccc

SEQ ID NO: 6108 - DNA, 116 bp, Zea mays
gttttttagactcagttagcatacagagtagacggtgggttaaacacaaaagacgttttagttgaagttgtacacaattcaacatgagtcatgttggctagaggatggaaggttag

SEQ ID NO: 6109 - DNA, 194 bp, Zea mays
gacagattgagtgttggcggctagctcccatatgtttagagtctagggaaggaataaataatcgagacaagtcttatccctgtatttttgtagagaggtatttgaaacaagaagttcatcaaatacaagggaaaaatgtcatggcgacaaatatgttagaaatctatggagttctatgtttaatttaatctgaa

SEQ ID NO: 6110 - DNA, 80 bp, Zea mays
ccgggcccctaagggctgatttggtgaccctccaatcctcccgtgatccccttgtcaccaaatcaatcctaatagttagc

SEQ ID NO: 6111 - DNA, 173 bp, Zea mays
cccaagcactgttagatccggcacggattgagaccatgccggttcagcccggattagatagcagaccgtgttgtaccagcccacgggcctcgagtgaggcttagacacgaccggctagattaataatcgtgtcgggtcggtccacgaccgtgatggacctaacggacccataa

SEQ ID NO: 6112 - DNA, 137 bp, Zea mays
gacgctaaaggcctgtttggtttgatgtctaacttgtcacactttgtctaacttttcggttagttctttaattcgaacgagtaatcttaggcaaagtgtgatacatttagccacgaaccaaacaacccgtggcatct

SEQ ID NO: 6113 - DNA, 84 bp, Zea mays
gggcacaaagaccaacgacctccgggcagagctcaaccgcaggcgtgcgggagaggacgcccgggtatccttggaaagggcgcg

SEQ ID NO: 6114 - DNA, 141 bp, Zea mays
  unsure (133)..(134)..(135)..(136)..(137)..(138)..(139)..(140)..(141): n = A, C, G or T
actaagggcatgtttggttccttgtctaacttgccacactttgcctaacttttctgcctaaggttagttcttcaatttgaacgactaaccttaggcaaagtttgtcgtagttagccacgaaccaaacgacggnnnnnnnnn

SEQ ID NO: 6115 - DNA, 224 bp, Zea mays
  unsure (44)..(45)..(46)..(47)..(48)..(49)..(50)..(51)..(52)..(53): n = A, C, G or T
tccactaagggggtgtttggtttctagggactaatgtttagtcnnnnnnnnnnctacggactgatgtttattcccttcattttattacattttagttccaaaattactaaatatagaaactaaaactttattttagtttctatatttagcaatttatagactaaaaaggaataaaatgaagggactaaacattagtccctagaaaccaaacccccactaaactg

SEQ ID NO: 6116 - DNA, 134 bp, Zea mays
gtaaggccctgttcgtttccgtcggatggcacccggaattgtttcagctaatcaaagtttatataaattagagaaacaatccggtcaggaatcgttccgacccaccaatccggcagaaacgaacaaggcctaag

SEQ ID NO: 6117 - DNA, 111 bp, Zea mays
tctaggactacttttaggccttgttcagttacgttgaatatgaagggattaaatccccaccaatccagtccgatctctacgcaaccgaacaggcccttaggtgttagtctt

SEQ ID NO: 6118 - DNA, 159 bp, Zea mays
agatataaaaactaagggtctgtttggttcgtggctaactgtgccacactttgcctaaggttagtcgttcaaattgaagaactaaccttagtcagaaaagttaggcaaagtatggcaagttagccagagaaccaaacaggccctaagtgctaaaatgaa

SEQ ID NO: 6119 - DNA, 112 bp, Zea mays
cacccgttggcagagacaggcgtgtgggtccgcctcggcctatcccagtcccaccatagtgaggctgagctggtggacacggtgctccatgtcgcgctgctccgggtccacc

SEQ ID NO: 6120 - DNA, 149 bp, Zea mays
cgaagcggggagggcctgttcggttgtttgggattggagccccgaattaattcctagccgaattacttatctaatttatatagattttaataagctggaatgaatcctggcttattccggtacaaccgaacgggcccttagtaaattac

SEQ ID NO: 6121 - DNA, 120 bp, Zea mays
cccgttgggtacccgaaacccgcatgggtatgggtttgggcaaaattttatacccgtcacgggtatgggttttttagcggacgtattttttcttcgcgggtacgggtttgggcaagtaat

SEQ ID NO: 6122 - DNA, 191 bp, Zea mays
agttataggggtgtttggtttatagggactaaactttagtccctccactttattccattttagttcataaattgttaaatagggaaattaaaatagagttttagtttctatatttagtaatttagggactaaaatagaataaaatgggggactaaaaattagtccctagaaaccaaacacaccctatattt

SEQ ID NO: 6123 - DNA, 131 bp, Zea mays
agtataagataagggctgatttggtgatcaaggatcacggaagattgttagggattgaggaggaaattagtttatttccctatcaatcctcccgtgatcctttgtcactaaaatcaaccctaagagctaga

SEQ ID NO: 6124 - DNA, 86 bp, Zea mays
tttgtgttctgtggcatcgcacgggcacctacctagtatatattataagactagttagtggcccgtgcgttgctacagtttttaca

SEQ ID NO: 6125 - DNA, 108 bp, Zea mays
gcccactgaagctcctattagtgtgctgttaccttacagatggactgtgagaaaccacctgagcccaacacgagaggaagcggcacactgcgtagcgctctcatatag

SEQ ID NO: 6126 - DNA, 101 bp, Zea mays
cgaggacggggcgcggtgcgcggcgtggacggggacagctgcccgatccgtgaaaggcgtggggcaccgtgcccgcccgcccgcccgcgtgccgtattgtg

SEQ ID NO: 6127 - DNA, 145 bp, Zea mays
acattgtaagagcatgtttggatcggtgcctaacttgccacactttgcctaacttttctgcctaaggttagttcttcaattcgagcgactaaccttaggcaaagtgtggcacaattagccacgaaccaaacatgtcttaaaacta

SEQ ID NO: 6128 - DNA, 113 bp, Zea mays
ccgacggtccccgctaagccgtcggacataaggctctattatgtccgacgaccctcgctgggtcgtcggacataatagagtcttatgtccaacagcttagcgggggttgtcag

SEQ ID NO: 6129 - DNA, 111 bp, Zea mays
atagacaaaaagaggccagaggcccaatcctacatattgtgtatcgtgtgttctttgagtgtgtgaattgctgggaaagggaatgggcttctacgacttctcgctcctcta

SEQ ID NO: 6130 - DNA, 71 bp, Zea mays
acggctatagtgctgtgtctggaccaccatctcgatccgtagtgctggcacggacacaatacagttatatt

SEQ ID NO: 6131 - DNA, 144 bp, Zea mays
cagactattggcatgtttggtttgttgcctaacttgccacactttacctaacatttctgcctaaggttagttcttcaattcggacggctaaccttagtcaaagtgtggcatagttagccacgaaccaaacgtgccctatgtcca

SEQ ID NO: 6132 - DNA, 132 bp, Zea mays
cgtccaggtcgcgacacgactcccggggcaggcgtggacgaagccagctcctctctcgcaggcacgacggccgtcctcaggcgcggacgccggcgcgtcgccgtgggaggccgtgtcgcagaggcccaggtc

SEQ ID NO: 6133 - DNA, 159 bp, Zea mays
actaggaacgtgctcgtacgatgccacggaacacaaattgcgacctttcacggtacagagatttgtttgtttaggttaaaaaaaatatttaatcccttcaaaaaaaatactccaccgactgtacttcatttttccttgcatcgatggtacatagatttc

SEQ ID NO: 6134 - DNA, 240 bp, Zea mays
agaggattaagggggtgtttgagatggctccaggttttagcttcagtgtggagttgtagtttataatatcaatttaattagtttttaaaatattttaatctaaataataaacaaattacttatctaaatgtcttttaaaggcttacaactctaactctgacgattttctagagcatctaatgacctgcttcaccaaatttcttggagctggagctatcccaaacagggtctaaatctcct

SEQ ID NO: 6135 - DNA, 82 bp, Zea mays
ctttagtcgtgtttttgctcagctatgcccttccagtgctatagaacagaagggcacagctgagcaaaaaacacgactaagg

SEQ ID NO: 6136 - DNA, 129 bp, Zea mays
ctctcacctacgggtcttcggctgcctcgcgttcaccaaggagcttggccacatcggcaggctcgacgacaggagcaccccaggggtgttctttggctacgcggagggctcgaaggcctaccgcatcct

SEQ ID NO: 6137 - DNA, 188 bp, Zea mays
agacagctaaggccctgttcgtttgttacggattgatggatcggaacgattcctaatcggattgctttagtttatataaacctcagctggaacgattccggggattgcttctctagtttatataaatctcaacgggaacgattctggatgtaattctacacaaacgaacaaggcccaaagaagaaata

SEQ ID NO: 6138 - DNA, 219 bp, Zea mays
gcaccttgaagaggacggaggtgccgtcggtgtcgtgcgcgaacacgatgctggtcttgaacggccggtcggtgcgcgggatgatgggctcccgcgccagcatgacgaagcgggtgacgttgccggcgtcgtcctggatgccggcggcgaggacctggaggccgtagagctcggcggcgcgcgcggacgcgatggcggcggtgtcccggaggccccccg

SEQ ID NO: 6139 - DNA, 126 bp, Zea mays
gggctgtttagttcgtggctaaatgtgtcacactttgcctaaggttagtcgttcgaattgaagaactaaccttagacagaaaagttaggcaaagtgtggcaagttaggcatcaaaccaaacatgcc

SEQ ID NO: 6140 - DNA, 102 bp, Zea mays
tgtgccccatccgctctcgggttacgatatcctgttcaccaccctccggttgggccgttgcagagtggacggttgacgccggcccgttagtgatggggtgcc

SEQ ID NO: 6141 - DNA, 150 bp, Zea mays
gaaaggtgaagggcatgtttggttcgctgcctaacttgccacaatttgcctaacttatgtgcctaaggttagttcttcaattcgaacgactaaccttaggcaaagtgtggcatagttagccacaaaccaaacaggcccgaaaactttcgg

SEQ ID NO: 6142 - DNA, 87 bp, Zea mays
tcaggtgctggccgggcaccgggcaagcacgaagggacggacgaccggtatgatgatgcggtgcccgccgcccggcactaaccgcgc

SEQ ID NO: 6143 - DNA, 123 bp, Zea mays
aattgtttttagactcagctagtgcttatggcaaaccaaacccctcagccaaacagctgcatggtctagaggtagaggagtagactcctcacatcgggtaagtctagctgagtattagtatac

SEQ ID NO: 6144 - DNA, 162 bp, Zea mays
ctttagagttccttgttggaggcgtaggggacctgaccgtcccctacatttagcgggacaggatcctttacaggactttgttggaggcagcctaaagcctcctgtactctaaatatagaaaaccaaatggtcctctacgctctccaacaacgtcctctaaac

SEQ ID NO: 6145 - DNA, 190 bp, Zea mays
  unsure (179)..(180)..(181)..(182)..(183)..(184)..(185)..(186)..(187)..(188): n = A, C, G or T
tttagggggtgtttggtttctagggactaatctttagtccctacattttattctattttagtacttaaaatgctaaatatggaaactaagactctattttagtttccgtatttgacaatataagaactaaaatggaataaaatgaagggactaaagattagtccctagaaaccaaacannnnnnnnnnag

SEQ ID NO: 6146 - DNA, 67 bp, Zea mays
gcgcgtgtcgctcccgcctccgacgcggaggacgacgacgacgacggaggcgagagggaggagtcgc

SEQ ID NO: 6147 - DNA, 151 bp, Zea mays
ccggtcacgctcggctcggctcggctctcttcccctctgcagcctgctgccgcggcatgctctcttatgcgtactgcctcaaggcaaggcatgcgttgttgtagtatgcagcatgaggagaaggggccgaacttggcatgagatggatatc

SEQ ID NO: 6148 - DNA, 212 bp, Zea mays
  unsure (80)..(81)..(82)..(83)..(84)..(85)..(86)..(87)..(88)..(89): n = A, C, G or T
ccgctgtagaggaacaacaggcaccgagatccgagccaccgttggttgtccctattccagtcacttcaacgtctaggcgnnnnnnnnnnaaactatcgtttatatggttgagagtgtaacactttaataggctaacttttagcggagtgttcgcccaacaaatctaaaatttgcagttgtgcgttcgggtgtgtgttgcgactcggcagcct

SEQ ID NO: 6149 - DNA, 144 bp, Zea mays
ggcaaaaaataggctatctccagcaggtttgtgtatatgggcgtgcaaagtactgttttgcactgtagaccgcaaagtttacaaagtggagttttaaatagacagtgggatagagaggctgctggagacagccttgttagattg

SEQ ID NO: 6150 - DNA, 158 bp, Zea mays
aaaaaaatgtaggctaatccaacagacttggtaaacctacagactgaatagagagtgaagcaaactatccaaaaatggagagcgaatattgagggatagagaaccactaaatttgaagagtcatttacagagtctattggatacacctttcttctaat

SEQ ID NO: 6151 - DNA, 148 bp, Zea mays
aaatttctctgagggctagtttgggagtccaaatatcggaggggttagaagggttaaaataccttattcaaaattgaataagaaagaattttagccactccaatctccttcagttttatggctcccaaactagcccttaattaataaa

SEQ ID NO: 6152 - DNA, 87 bp, Zea mays
ggcggctgcgcgagctccaggcgaggcggctgcgtgagctccaggcgaggcgaggcggctgcgcgtgctctgagctgcgacgacagg

SEQ ID NO: 6153 - DNA, 171 bp, Zea mays
tcgcgtgcgcggccagccaggccgagaagaaacgggaactcctggcgtgccgctggagccaggctggggagggggttttgcacgagcggatgcagcgtctggatgcagtgcaggcaaccaaacagccggacattggatctcatgggccaggctgggccaaaaccaggcaac

SEQ ID NO: 6154 - DNA, 104 bp, Zea mays
tggttcgtggctaactacgtcacactttgccttagtcgttcaaattgaagaaccaaccttagccagaaaagttaggcaaagtgtgacaagttagccagggatca

SEQ ID NO: 6155 - DNA, 97 bp, Zea mays
  unsure (1)..(2)..(3)..(4)..(5)..(6)..(7)..(8)..(9)..(10): n = A, C, G or T
nnnnnnnnnntatctccgacggctcggtacgaggccgtcggagataaccttatgtccgacggctctgtacgaggccgtcggagataaggcctatgta

SEQ ID NO: 6156 - DNA, 101 bp, Zea mays
gagtgttttatttttgacactcggcaaagagtttctttgccgagtgtctttttttatactcggcaaagggctctttgccgagtgtcacaaatacaacactc

SEQ ID NO: 6157 - DNA, 172 bp, Zea mays
ttggagaaaaaacactcggcaaagagctctttgccgagtgttgtatttgtgacactcggcaaagagccctttgccgagtataaaaaaagacactcggcaaagaaactctttgccgagtgtcaaaaataaaacactcggcaaagagcttcttcgccgagtgttttcttttacc

SEQ ID NO: 6158 - DNA, 74 bp, Zea mays
acgccgatcaggctgcgttggtaatcggctgagttatggcattagctgaatattgactgcgccctggcaacacg

SEQ ID NO: 6159 - DNA, 215 bp, Zea mays
aaaattacacggtgtccaatttgttgggcacagctgcacccataaaaaagactcaattatatgataggtgataaaaggcttggcgattcaaaaaaaacgcagttaccgctcccacctcgccaaatcaaatggcatatttgtttaccctagtgctgagaattgggccggccaagtctatcgtgcttcgtgccaaatggattcgaaccaggaaagca

SEQ ID NO: 6160 - DNA, 79 bp, Zea mays
actcgggcctgcgacgcacgggcactcacctagtgtattatataagataggtgagtgcccgtgcgttacaacggcaaca

SEQ ID NO: 6161 - DNA, 79 bp, Zea mays
tgttgccgttgtaacgcacgggcactcacctatcttatataatacactaggtgagtgcccgtgcgtcgcaggcccgagt

SEQ ID NO: 6162 - DNA, 133 bp, Zea mays
gctgaccgctgagcgtgtagccgcgtacagattgaaagcttagggcgtgtttgtgaccttggcccagctcggcccgttcaactggtccaggctgaggctagcctgtcccggctactgcaactcattttgtttg

SEQ ID NO: 6163 - DNA, 104 bp, Zea mays
cgagctaacgagccacgagcatttcgttcagccctatttccttgctacttcgctctttgggcctttaatagggctggacaaaatgctcgttgttcgtcggcttg

SEQ ID NO: 6164 - DNA, 86 bp, Zea mays
catgtcacacctcggcgtcataggatgtagcaccgagatgtgttacctcggcgccatagcctatggcgccgagcatcgagtccaaa

SEQ ID NO: 6165 - DNA, 207 bp, Zea mays
tggtcgctgccaccaccaggaggagggtacacaaagtgggactcgacaaaagttgatctagctggttcagtcccacccccacccgttccaggcgtagcctatgtaagaatgcaaatatcaataagttaagtatacaaatgtataaaatcataagaatatttcgagagttacaaaatgtatctggtcttcaggtgcaggtagggatga

SEQ ID NO: 6166 - DNA, 77 bp, Zea mays
atcctcgggcccctggggcccattggtcagagagagcgcatcagaggaggaccactggctaccagggggctggggcc

SEQ ID NO: 6167 - DNA, 252 bp, Zea mays
gtcgtttttagaccctttgtttggtgcgtagaccatgatgtattcagtagatctggccaatactccggttttggtacgacgggacataggagctcagcgccataattaatggcaccgagcaacaccacatagacgccaacgcaataggaggagtcctgtgcactatgtacctcggcagcataggctatggcgtcgagcggtattatctcagtgccatggtctatagcgccgagcaaagggtccaaaaacgat

SEQ ID NO: 6168 - DNA, 215 bp, Zea mays
tcgctcggtagccaggctccccacgcgcggcagctcgctcgcagccgcattcgctcgcgcagccccgcatgctagggtttcccgagctctccctcgagctggatcccgcgtgctagggtttgccgtcgtctcggccgggtacaccatctccactcgccctccctatctccctcgagctggatcccgcgtgctagggtttggcgccgcctcggccg

SEQ ID NO: 6169 - DNA, 150 bp, Zea mays
ggatgtttttagggtctgtttggttcgctgcctaacttgtcacactttacctaacttttctgcctaaggttaggtcttcaatttgaacgactaacctgaggcaaagtgtggcgcagttaggcacgaaccaaactggcccttagtgataat

SEQ ID NO: 6170 - DNA, 148 bp, Zea mays
ctaatagagcacgggtgagttcgcctgtcgacatgcattacgcctctgtttgccgagtgtcatcctatgaaggctcgaatcacatatgcatgtaaccagtagaaggcacgatgcatatcgtcgtcggcaagctcgctcatctgcatca

SEQ ID NO: 6171 - DNA, 144 bp, Zea mays
aatatttagggcctgtttggttcgtggttaactacgtcgcactttgtctaaggttagtcgttcaaattgaagaactaaccttaggcaaaaaagttaggtaaagtgtggcaagttatgcagggaaccaaacatgcccttagtttg

SEQ ID NO: 6172 - DNA, 184 bp, Zea mays
gatgattgatgtttggtttctatggactaatgtttagtccattcgttttattctattttagtctataaattgctaaatatagaaactaaaatagagttttagtttctatatttagcaattttgtaatggaataaaatataggaactaaaaattagtccctagaaaccaaacacgcctgagtaag

SEQ ID NO: 6173 - DNA, 147 bp, Zea mays
cggtccgcacctgacagcttgttcgctgcggctttaatccagctgcggctgcgtcttctacagtattttgtctctatggattgcagctgcagcagtccgaacggctttaatccagccgcagcgaacaagccgtgagaattaagatac

SEQ ID NO: 6174 - DNA, 167 bp, Zea mays
ttgttggcttgtgtgacattgcagcgtggacctacacaacaagatactatcatgtgttccacaacagtgttgtgacttaacgactagttgggacttgggagctaggagtaccgagtatttatgtcccttcttccaccttccacctgtcatgtcacgcatttcctcct

SEQ ID NO: 6175 - DNA, 232 bp, Zea mays
acagttgagtggagtggctgtctgcgggattcacggcgtagtaggtggccaagactgagctcgggcgaggcgaagaattcgcccgagggtcgaacttgacgtcgggtgaggcggagaaatcacccgaaggctggacccggggtcgggcgaggcggagaggttgtgccatcggactgaatactgcttcgggcgaggcggagagattgcgccggagggtcagtctgctcggctt

SEQ ID NO: 6176 - DNA, 128 bp, Zea mays
ggttggcgtcattgctgctgcgggtgattgtgacaggccactgtgggacttcggctcggcatcaatctggagccgaaaggaaccaaatgaatgatggcatttactagtagctagtagtatgctgggtg

SEQ ID NO: 6177 - DNA, 133 bp, Zea mays
agagctagtttggaagtccaaataacggaggagatttggaggagctaaaattcacttcttattcaattttgaataaggagggggattttagccctcgaataccctccggttttgtggcttctaaactagccct

SEQ ID NO: 6178 - DNA, 150 bp, Zea mays
aggaaccctgaggtcctgttcgtttacatcggattgtacccggaattattctagctaatcaaagtttatataaattatagaagtaatccggctcggaatcgttccgacccaccaatccgacacaaacgaacaaggcctgagtttggttgg

SEQ ID NO: 6179 - DNA, 240 bp, Zea mays
gttaggaggtgtttagttacacctcgctaaaatttagcccctgtccaatcgaatgtttgaacctccgttccggatattaaatgtagtcggattataaaactaatttgtcagccgaagattaaaagacgagacgaatctagtccagttggttggatctatatttcatactcctatttaaaagtcaaacgcttgatgtgacccaagctaaactttagcaggagcaaccaaacacccttttat

SEQ ID NO: 6180 - DNA, 140 bp, Zea mays
cataaagggcatgtttggtttgtggctaaatgtgccacactttgcctaaggttagtcgtccgaattaaacaactaaccttagacagaaaagttagccaaagtgtggcaacttaggtagtaaaccaaacatgcctaaagac

SEQ ID NO: 6181 - DNA, 70 bp, Zea mays
agcaaggtaaaacgggttcaacggctcgacgacaaacgcgagcacgcgtgaagcccgatggacgaagagc

SEQ ID NO: 6182 - DNA, 127 bp, Zea mays
cacttcccactgtgtagctcgtttggctcgtgaaaatcaagtttggctcgttaagaactgagctaaattgttggctcaactcatgacccattttcaacgagccgagtcgagccaccagttttttgtc

SEQ ID NO: 6183 - DNA, 78 bp, Zea mays
cctgaactgcgccggatcggaggatgtcatgcgcgcacctcgcgccttccgtggacatcgtttgatcctcgtgcctcg

SEQ ID NO: 6184 - DNA, 112 bp, Zea mays
aatctcttttagggctgatttggtgactaggtatcatgaagggattggaggagattgagagcctccaatccctcagtgatcccttgtcaccaaatgaacccttatagcctct

SEQ ID NO: 6185 - DNA, 201 bp, Zea mays
accaagggtgtgtttggttgcgagacagccaggacagagacgtcccctgacgtcctcttttgtctctctaattttgagggataactgggaacaacactgagatagtcatgtcccaatatttgatcctgagccaaataatcttatttgagggattgtctcatcctgtcccgtcctgtcattgcaactaaacacaccccaaca

SEQ ID NO: 6186 - DNA, 189 bp, Zea mays
ggtgtgtttagttgcaatgacaggacgggacaggatgagacaatccctcaaataagattatttggctcaggatcaaatattgggacatgactatctcagtgttgttcccagttatccctcaaaattagagagacaaaagaggacgtcaggggacgtctctgtcctggctgtctcgcaaccaaacacacc

SEQ ID NO: 6187 - DNA, 89 bp, Zea mays
tcacgccttcggctcaggcacgacccggtgactgggtcgggccggcacgggttcagttcactatgtgtcgtgccgggccaaacccgtgc

SEQ ID NO: 6188 - DNA, 72 bp, Zea mays
aggatcactggagcctggctctggagatgcgatcaatctgctcgtatctggtgagcctggcccagggtgctt

SEQ ID NO: 6189 - DNA, 72 bp, Zea mays
aagcaccctgggccaggctcaccagatacgagcagattgatcgcatctccagagccaggctccagtgatcct

SEQ ID NO: 6190 - DNA, 119 bp, Zea mays
atatttttctagactcagtgagcatacagagtggacggtggattaaacacaaaagacgttttagttgaagttgtacacaattcaacatgagtcatgttggctagagggtggaaggctag

SEQ ID NO: 6191 - DNA, 71 bp, Zea mays
tctcttggcaccgcccctgcagtcctgaactcctgattgtcggcggctacaccggcggctaactggctaca

SEQ ID NO: 6192 - DNA, 87 bp, Zea mays
cgtcgggctgcggctgcggctgcggctggtagtaggaggggttggcgtggcccatgccatcgccactgccgtagccgtagtacgggt

SEQ ID NO: 6193 - DNA, 156 bp, Zea mays
taacgatgcactaggggcatgtttggttcgttacctcaattgccacaatttgcctaacttttctgtctaaggttagttattcaattcgaacaactaaccttaggtaaagtggggcatagttagctacaaaccaaacaagccctaggtgattgagtt

SEQ ID NO: 6194 - DNA, 101 bp, Zea mays
aggggtaggcggcgccacagattttggcgcctaccccctttaaactatacaacaacgtgtttggaggtaagcaccaagatctgtggcgcctacccctttaa

SEQ ID NO: 6195 - DNA, 141 bp, Zea mays
tgttcaattaagggcctgttcgtttcacatggaatgaaggggtggaataaatctggcttggattccttcaataattactataattttggagatttggaattaatcctggtctgttccagcagaaacaaacgagccctaaat

SEQ ID NO: 6196 - DNA, 69 bp, Zea mays
tccgctgatggctgctgctgcctttcagttcgtttcacaggcaggcaggcaggcagcgtctgaactagt

SEQ ID NO: 6197 - DNA, 246 bp, Zea mays
ctgatgaataggtagccgttggagggagtaccagggaagcgataagaagccatttactactggcagccattctcagcttgagttggagtagggtcgggtcagaggtcagaggcattcaagcccgtgcgtcagccccggccgtcaccaaggaaggctgcaatggcttggcatatgtggcccgtcaggctcacagctcacctcattcaagccccatcagactgtcttcagcggttgcccctaaatttg

SEQ ID NO: 6198 - DNA, 191 bp, Zea mays
  unsure (145)..(146)..(147)..(148)..(149)..(150)..(151)..(152)..(153)..(154): n = A, C, G or T
taaaagacaccgtatcttatgagcaaggagctctgctgctcccatgagcaaaatcaatccagaccacaccctccacatccaacggtgttgcgtcagggggtttttgtaaaatgtacagagttgcaaagaacatttacaaaaaaannnnnnnnnnacctgctccttgcgcacaagatacgttctcatagtaa

SEQ ID NO: 6199 - DNA, 139 bp, Zea mays
gactaagggcatgtttggtttgtggctaattatgcctcactttgtctaaggttagtcgtttaaattgaataactaatcttaggcaaaaaagttaggcaaagtgtggcaaattagatagcaaaccaaacaggccctaaaa

SEQ ID NO: 6200 - DNA, 191 bp, Zea mays
gctaaaatttagcccctatcacatcgaatgtttgaacctccgttcggagtattaaatgtagtcggattataaaactaatttctcagccgaagattaaaaagtgagacgaatctagtacagttggttgggtctatatttcatactcctatttgaaaatcaaacgcttgatgtgacccgggctaaacgcttga

SEQ ID NO: 6201 - DNA, 153 bp, Zea mays
gacgtcagatgaagatcgtgtggctggcaaggcaagtggtgacgtggacaaacgtgatgcaggctttgctcccgcgtttaatatatagaaatagcgctgtgttcgagctatgtcacaatttagtagtgggtggcaggatagtcagttaagccg

SEQ ID NO: 6202 - DNA, 255 bp, Zea mays
ctaatatttttataccaaaccatgaactcgttattcattacataaattttggacaatgatcttattaatcattatgatacttattgattataaaaataataagcatattggagataaaaacccgcgggtaacccgtgggtacccgcaaacccgatgggtacgggtttgggcaaaatttcaaacccgtcatgggtacgggttttttagtgggcgtaaatatttttcacgggtacgggtttgggatagcaaaaccca

SEQ ID NO: 6203 - DNA, 139 bp, Zea mays
acatgttaatgggctgactggtgttgggcctgtaactgcgatagtccggcactgtagtcgggtacccgctaaccgggtacccgtatccgacccggacttctcgggtatttgccggatagtagtcatcccgtatcctact

SEQ ID NO: 6204 - DNA, 235 bp, Zea mays
aacgtgctgtgcgcactcgcgtcgctcgcggggttcgacaggtgctcatccgctggaagggagaacccgcagcatcctccacatgggaagacctcgacgccttctccgccaagtacccagcgttccagctcgaggacgagctggtggtcgagggggggagagatgtcatgtacggcatcccctactccaggcgacgtcgcgcccgcgacatacgcagggcagccgagcatgcagc

SEQ ID NO: 6205 - DNA, 151 bp, Zea mays
caacgctttcccgacgctcttgcttggggacaagcaacttctccagagggggcagatgtcaggcttgtgcctaactgacaaggcgtcatcagagaagagaaaggcaagaggttgctggttgcgtagcattgggcgtgtgtggttgtgtggg

SEQ ID NO: 6206 - DNA, 71 bp, Zea mays
gatgctcggtgccataggctgtggcgccgaggtaacacatctcggcgccacaacctatggcgccgaggtat

SEQ ID NO: 6207 - DNA, 74 bp, Zea mays
tgcatcggtagagcctggctctggagaaacgactaattcctacgtatctcgggagccaggcccaagggagattt

SEQ ID NO: 6208 - DNA, 79 bp, Zea mays
attaggccttgttcgtttccgtcggattgtaactggaacgattccgggtgcaatctgacataaacgaacaagaccttaa

SEQ ID NO: 6209 - DNA, 182 bp, Zea mays
cgggcgaaggccgtgccgcgtcccgttgtcgtttgggtccatttgtaagcctctctatggcgtaggatcaatagtacgtttagtcaaactttacttaacatcgatgtaatattctagagctgtaaggtgggatattctaggactgtagcaggtaaccgtggacgtaacagggcgtatctacc

SEQ ID NO: 6210 - DNA, 106 bp, Zea mays
tcttggcgccagaggtgacgtagaggaggaccgacagcaatgaccactcgccatcatcggggtagcttttgtgccggcctgcctttaattctcttcgcaaacacat

SEQ ID NO: 6211 - DNA, 217 bp, Zea mays
tgcaatcagaccttatgcacaagcgtgcaaacgagcctcttggtccgttagatcatgatctaactgtagacatgaacgtggtatgttagggggttttctataaatctactcgagccggtggtggaagagtttaaatgttaaatgagatacatgattggatcataatcaaacgaaccaaaaaccttgcttgcacgcttgcacataaggtccaattcat

SEQ ID NO: 6212 - DNA, 188 bp, Zea mays
ctcattgtgcgggggtgtttggtttctaggtactaatttttagtctcttcattttattttataaattatcaaatacgaaaactaaaatagagttttagtttccgtatttgtcaatttagagactgaaataaaataaaatagatggattaaaaattaatcctcagaaaccaaacacccctaacactggt

SEQ ID NO: 6213 - DNA, 158 bp, Zea mays
gaaaaaaaattatgggcatgtttggtttcctgcctaacttgccataatttgcctaactttttctgcctaaggttagttcttcaattcggacgactaaacttaggtaaagtgtggcacagttagccacgaaccaaacaggcccatatatatatatctcc

SEQ ID NO: 6214 - DNA, 100 bp, Zea mays
cttgttcgttgcggcttgctgcggctttaattcgattgcgactacgacttttacagtattttgtctctatggattacagttgcagcagtccgaatagcta

SEQ ID NO: 6215 - DNA, 82 bp, Zea mays
taggctatgtccagcaggccatgtaaacgtcgttgtaaaatactattttacactgtagattgcaatggttgtaagtgtagtt

SEQ ID NO: 6216 - DNA, 144 bp, Zea mays
ggaactaagggcatgtttagtttggtgtctaacttgtcacactttgtctaacttttctacctaaggttagttcttcaattcgaacgactaatcttaggcaaagtgtgacacatttagccacgaaccaaacagtccctaaatatc

SEQ ID NO: 6217 - DNA, 151 bp, Zea mays
aacccttccctaggccttgttcgtttacatcggattgcacccggaatcgttccggctaatcaaagtttatataaattagagaagcaattcggctcggaattgttccgacccaccaatccgacacaaacgaacaaggcactagctggctaga

SEQ ID NO: 6218 - DNA, 70 bp, Zea mays
gacggccactgccgcagcggtgtcccctggcccgaccatctcgctagaggacatcctcgggaacatgtcc

SEQ ID NO: 6219 - DNA, 193 bp, Zea mays
taattaaggggtgtttggtttttagggactaatgtttagtccctagattttattctattttagttccaaaattaccaagtatagaaactaaaactttattttagtttctatatttagcaatttatacaataaaaaaggaataaaatgaagggactaaatattagtccctagaaaccaaacgaccccttaacct

SEQ ID NO: 6220 - DNA, 134 bp, Zea mays
agcataagggcctgttcggttgtccaggattggaaccagaattattccacctgatgaaatcttatataaaagtaaacaattaggcaggaatagtttcaggccacgttcctgagcaaccgaacagcccaaagtcg

SEQ ID NO: 6221 - DNA, 249 bp, Zea mays
caccttaatgagcatcgcactagcacattaatttattcatcgatcgaactattctgaataatttatcagcttaccatttccacagctgacacgaattcgcgagatcggtagcgattttccgatctaggcaatttgtcgagcgcttggggaatatcgcgctgctagcttcgtcttcatccgatttttgggatttcttgatgacgcatgaaacgatgacgagatcgtgtttggagcgagctggtgaggtgg

SEQ ID NO: 6222 - DNA, 77 bp, Zea mays
  unsure (67)..(68)..(69)..(70)..(71)..(72)..(73)..(74)..(75)..(76): n = A, C, G or T
cctttggctcggcgcatagccaatggcgccgaggaacacagctcggcgccataggctatggcgccgnnnnnnnnnna

SEQ ID NO: 6223 - DNA, 170 bp, Zea mays
ggtttgaagtcaaagtaggatgagtcgggggcgccaccgtcccctcgattttttgggatcacgtcgcccccaaaaatcactccggtgctcaacctcgccctcgcttgactctcaaccaaacactatagaaaacgtggccgcctcatctcatccctctttgtacattcaac

SEQ ID NO: 6224 - DNA, 156 bp, Zea mays
tcactcaagcctaggtgctgtttggttcgtcaatagtagcaaatggaaacaaattagagctgtggacgttaccgcaggacatgcaatttgaattaaatttcatttctatttgcgttactattaaggaaccaaacagcacgctagtgtctaattgtt

SEQ ID NO: 6225 - DNA, 89 bp, Zea mays
ccatcctttgccctgtaaggccatgttcggttacaccaatccccctctggattggtctaaccgaacaagccctaatgggaagaatggaa

SEQ ID NO: 6226 - DNA, 73 bp, Zea mays
ttcccattagggcttgttcggttagaccaatccagagggggattggtgtaaccgaacatggccttacagggca

SEQ ID NO: 6227 - DNA, 148 bp, Zea mays
tcgtggctcgtgagctcgctcgactcgtggccagctcggctcggcttgactcggctcgtttcaattttatcacgagctgagctaacatctcagctcggttcgttaacgagctagctcgacacgagctcgagccagctcgttagctcga

SEQ ID NO: 6228 - DNA, 192 bp, Zea mays
atttattatgtgtttggttgcgagacagtcagaacaggagcgtccctctttcgttcctcaaattttaagggataactggggacaacactgggatagtcatgtcccaacccctgaccctgaaccaaacaaacttatttgagagatcgtcccgtcctatcccgtcctgtcattgcaaccaaacatattaaagat

SEQ ID NO: 6229 - DNA, 135 bp, Zea mays
acattctttagggtcgagctggatcgttgtttctactctttgggctggcatgacacgacccaaaagttttttttgggccttctcactccgagtctatttggcccgaagcacgataggcttgctccggccaggcta

SEQ ID NO: 6230 - DNA, 117 bp, Zea mays
gctaatttgggagccacaaaaccggagaggattggagaagctaaaatcctctccttattcaattttaaataattttagatccttcaatcctcttcagtatttggactaacaaactag

SEQ ID NO: 6231 - DNA, 175 bp, Zea mays
gaaattcgcccccgagggggatcgaactcgggacctgaatttgctactcgaaagccttaaccattacgctaagtgctacgtttggtcactacaagatgacactttggactcgtcttagatggtctgagtatcactccttaggtcctgggttcgactctccatgggagcgaaattt

SEQ ID NO: 6232 - DNA, 184 bp, Zea mays
tttcggtgcgccgctgtaagtttgggtatccatgctgtggtttcaagatcagagttcatggcagatagttatgtacacaggcggcaaatttggttcttagcttaggttgatgaccagtttcacttagtacatcttatatgtatactaggtggatgcccgtgcgttgcaacgggaagataaaata

SEQ ID NO: 6233 - DNA, 192 bp, Zea mays
gaaacaagaggacgtttgatttttagggactaatttttatcactctattttattctactttattctctaaattggcaaatacagaaattaaaatagagttttagtttttgtatttgacaatttggagactaagatgggaaaaaatagagggactaaaaattagtccctagaaaccaaataccttctaagtgt

SEQ ID NO: 6234 - DNA, 80 bp, Zea mays
gcagagtgtcagactcggcaaagccttcaccgagtgcgccgagtgtttttctaggctttgccgagtgcttcagacactcg

SEQ ID NO: 6235 - DNA, 72 bp, Zea mays
ttatacccctctgccgcaggcttggttcctagggtagcagccctaaggcgcttgagatgggcataacaagag

SEQ ID NO: 6236 - DNA, 79 bp, Zea mays
ggtctcgcctcgctaggttgctcggcgagcgggttggtcagtagcttcgcctcgctgggttgctcggcggatattggtt

SEQ ID NO: 6237 - DNA, 72 bp, Zea mays
gcgctagtgggatggtcggcctgggcttcctttaactgttggaagcccagggctcccgttatacctgccctc

SEQ ID NO: 6238 - DNA, 130 bp, Zea mays
acaatgtccctgccgccggagcgctccaggacgtcgcagtaccggcgagggcgttcaccgccgcgacggccgcggactcgggaggtcgtcgtcgagcgcgttgtggagcgcgtcgtggcgcctggaacga

SEQ ID NO: 6239 - DNA, 177 bp, Zea mays
tttagcctctgtctcattgaatgtttgaacctccgttccgggtattaaatgtagtcggattataaaactaatttgtcagccgaagattaaaagacgagacgaatctagtccagttggttgggtctatatttcatactcctatttaaaagtcaaacacttgatgtgacccgggctaaa

SEQ ID NO: 6240 - DNA, 153 bp, Zea mays
actcgatattgagggctagtttgggagcaataaaaccgaagaggattgaaggggctaaaatcttctccttattcaattttgaataagaatgtggttttagcccctctaattctctccggtttttggactcccaaactagttttgaagaggaga

SEQ ID NO: 6241 - DNA, 132 bp, Zea mays
aattagagaagcaatccggtcaggaatcgttccgatccaccaatccggcagaaacgaacaaggcctaagggttgttcggttgctcaggaatgatggcttggaactattcgtgactggattgtttacctattt

SEQ ID NO: 6242 - DNA, 135 bp, Zea mays
taagaacgtgggtaccgtcgaacttaaggttaagaacgtgggtttttaagttcgacgggggccgtcgaattttcttccataagttcgatggcacccacgttcttaaccttaagttcgacggtgccacgtggtcgt

SEQ ID NO: 6243 - DNA, 85 bp, Zea mays
ccataaaatcggaggggattggaggggttagacccttttttattcaattgagaatttagcactccaatcctctccggttttcgag

SEQ ID NO: 6244 - DNA, 193 bp, Zea mays
gtgagagagaagcggtccgctacgaagggggcacggtagagggctgcgctgcgggacgtagaggtcacctgtagcccctaagcaatgaataggaataggggagaggagggctagagtgcggcgctgcagacagtcttataaaccattctcatgtatctcttttgttagccccctagagtgaccaaatgttaag

SEQ ID NO: 6245 - DNA, 123 bp, Zea mays
cctaagagtgagggttcctatatgcaccgaggagataaggcccctgagaagtggggggccagggcggtgaccccgagcattagtgtcgtggtacggtagtgttgagcgccttgcgcgatagtg

SEQ ID NO: 6246 - DNA, 135 bp, Zea mays
ctgtcttaagggagatttgttcatcatcatatgagcttcactatctgatgtagagcacaaaacatgtatagctcggctaaggaaactttgaaagttacctgctcacggcgaggtggactaactgctgacgatggt

SEQ ID NO: 6247 - DNA, 107 bp, Zea mays
tccatcctaaggacttgttcggttacaccaatacagaaggggattggtgaggtttaatcaccaatccccttttagattggtgtaaccgaacatgccctaaatgataa

SEQ ID NO: 6248 - DNA, 107 bp, Zea mays
ttatcatttagggcatgttcggttacaccaatctaaaaggggattggtgattaaacctcaccaatccccttctgtattggtgtaaccgaacaagtccttaggatgga

SEQ ID NO: 6249 - DNA, 126 bp, Zea mays
caagacatgtcatagacggagtggtaggggagggtacgcgtgagggtgaggttgacggttcaaatactaacaaccgcgtagcgcgcgaaaaatgccgcgacttgcgactttttttaaaatatgttt

SEQ ID NO: 6250 - DNA, 71 bp, Zea mays
gaggaggggccagtcgggtgggccgcttcaaggtccagctgatcgagcagcccaccggctggcagctggct

SEQ ID NO: 6251 - DNA, 149 bp, Zea mays
tagtggctacagtcagccgtaggaagttagctggctaacttcctaggggctacagtaagccgtaggaagttaggcagctaacttcctagaggctacagtaagccgtaggaagttaggcagctaacttcctaggggctacagtaagccgt

SEQ ID NO: 6252 - DNA, 86 bp, Zea mays
gcaggtcgcgtggggcgacgactcggctagcgcacctgctcacagcggtggtggcgtagcacggcccgcgcccgcacgcctgctca

SEQ ID NO: 6253 - DNA, 150 bp, Zea mays
aagtggattaagggtttgttcgtttgtgtcggattgatgggtcgaaatgattcctaaccgaattgcttctctaatttatataaactttgattaggtggaacgattccgggtgcaatccgacacaaacgaacaaggcttaaaggaggttga

SEQ ID NO: 6254 - DNA, 106 bp, Zea mays
ggcgaaataagactctcggcaacagcctcgtttaccgacagcgagacactatacatagaaagacattcggtaaagggggctttgccgagtgtcaaactctcggcaa

SEQ ID NO: 6255 - DNA, 114 bp, Zea mays
cacgactaacaggctcacgggccgtgcctgggccgcggcagcggcacgccggcccatctgggcacggcacgcttcgctagccgggcctggcgggccgtgccgccgtcgggccgt

SEQ ID NO: 6256 - DNA, 89 bp, Zea mays
  unsure (40)..(41)..(42)..(43)..(44)..(45)..(46)..(47)..(48)..(49): n = A, C, G or T
ctagcacactattcatcagtccagcaggcttcgcatccgnnnnnnnnnnagagtacgtgcccagtctcaggatgagaataaaaaaagga

SEQ ID NO: 6257 - DNA, 87 bp, Zea mays
ctttctctaacggatatgacactagaaggatttccaaacttgaagtatatacgaggacttttggtgtttggttcgctcaagtccctg

SEQ ID NO: 6258 - DNA, 152 bp, Zea mays
ctcccccgttgagggctagtttgggagccataaaatcgaagggggttggagggctaaaatcttctccttattcaattttgaataagaaagagattttagcctctctaatctcttccggtttttggattcctgaactaaccctgaaggtgacg

SEQ ID NO: 6259 - DNA, 102 bp, Zea mays
ccgagtgttttttttgacactcggcaaaaaaactatttgccaagtgttttatttttgacactcggtaaaaagcttttttgccaagtgtcaaatatataaaca

SEQ ID NO: 6260 - DNA, 145 bp, Zea mays
gttgatttaaggcctgtttggtttgatgcctaatttgccacactttgcctaacttttctgcctaaggttagttcttcaattcgaacgactaaccttaggcaaagtgtgacacatttagccacgaaccaaacggccccttatactc

SEQ ID NO: 6261 - DNA, 248 bp, Zea mays
gagatcgacgccggaggggggaatctcgcatcgtcgccaccgtcttcgcttgccttcatgcgtgctgcttccagtacgtgcgcttgacggcgcttgacgggatatgttccacctcctatggaccgggcgccgttcctaggccggggtggcggggaatggccaggctcagccgggatgcagtccatacgaggcttaatcgaacgttattttcttttgggtcgggattccttccaggcggcggaggtcca

SEQ ID NO: 6262 - DNA, 169 bp, Zea mays
aggattttcccacgttgctgccaaactagcccttagaaaaataaggttccaaactagccctaatagagtttttatccattgggtattagttacccattgattatctcttatctttgcagacaataattcaggaaaggaactgcggtctgtgtagtcaacaaagcacgcc

SEQ ID NO: 6263 - DNA, 71 bp, Zea mays
cctctacgctctccagcaacgtcctctaaacggtcctctaaatttagaggtcactgctggattctctatat

SEQ ID NO: 6264 - DNA, 100 bp, Zea mays
gttctgcaatgggtggccatgtatgtgtgagcccatggattatactaattcaataagctagtggtggtgcttgcatgtttgtgggggcccttggattgct

SEQ ID NO: 6265 - DNA, 104 bp, Zea mays
tcgaattagcgccgccgccatcgtcgttatggtccttattgctgttacagctatgctggccgtagtagactaccgtgtacatgagggcggcggtgccgctgctg

SEQ ID NO: 6266 - DNA, 107 bp, Zea mays
aaacgtccgacggccaaagccgtcggacataaggaataaaccgtcggaaatagattatttccgacggtaaagccttatctccgacggctttaagccgtcggagataa

SEQ ID NO: 6267 - DNA, 86 bp, Zea mays
cggcaatcctgcctcgctgggttgctcgacggtttggttggtcggtagcctcaactcgttgggttgcttggcgggcaggttggtcg

SEQ ID NO: 6268 - DNA, 97 bp, Zea mays
cctggcggctgaaaaccgacgggaataagccctaaatcgacgggaattaagtaattcccggcggtatatgcttattcccgtcggtttctggccgacg

SEQ ID NO: 6269 - DNA, 193 bp, Zea mays
aatcctggatgagtcggtacaggaaaccaaacacgagctcattaaatcctagctgagtcggtacagaaaatcaaacacgtaacaaattaactagttgcgtccatgtatacatgctaggctcagcctgcaggctctacccagccgaacaaccaatcagccggtatgtttcctgtgcgcgatttcatcaatttaa

SEQ ID NO: 6270 - DNA, 96 bp, Zea mays
cggaatcgtcctctttgtcgagtgtctcagcaaagcctagaaaacattcgacgaaggctttgccgagtgtgacactcggcaaagagagctcgacga

SEQ ID NO: 6271 - DNA, 141 bp, Zea mays
ctagcacaccaagggctgatttggtgatccgggatcccgggaagatcggaggggattgaaggggaaattagttcatttccccctcaatcctctccagtcctcccgggatccccttgtcaccaaattaaccccaaatgttac

SEQ ID NO: 6272 - DNA, 219 bp, Zea mays
acttatattggctctgtttggcacagcttattttcagcttctttacaaatttaagcagaatttctcctaaacagctagcttccgcagcagcttatcagttcagatgcttctcagaatatactaaaagcagccaacaagcagaagctgcttttcaccagcttatcagataagctgctttttcaacaagcaacagctgtgccaaacagggccattatatgc

SEQ ID NO: 6273 - DNA, 146 bp, Zea mays
catgtcatatgtccatcgggtgacggatatggataccgtatatccatgcccacgaaatttttacacgtggataccttatagtaaccatacccgtacctgcggatacgaaaatccaccatatccgtacccgacggataaataactgc

SEQ ID NO: 6274 - DNA, 138 bp, Zea mays
aaaccagactgtttgcagcccctcacaaaaaggagaatagatcccacctgcaggtgcaacaatacaatcaaaacgtgacctgcagatgaggtctacctcctttctgtgagagaggctacaaacagtctagtttacagt

SEQ ID NO: 6275 - DNA, 137 bp, Zea mays
ctgtaaactagactgtttgtagcctctctcacagaaaggaggtagacctcatctgcaggtcacgttttgattgtattgttgcacctgcaggtgggatctattctcctttttgtgaggggctgcaaacagtctggttt

SEQ ID NO: 6276 - DNA, 97 bp, Zea mays
cgccacacaactcgcgcccacggcatctgaccggcgtcaaaacccaccggcccagcccaacctgtctgcagaaaccgtcggcccaggcgccctttcc

SEQ ID NO: 6277 - DNA, 130 bp, Zea mays
gtgaagaatggggaggggcgggggagggtgataaaatagaggaaggagaggacacggcagctcgctcgcacacggaggagagttatttgagtttgtaacattctcgtcgcgcggcttcaccaatttatta

SEQ ID NO: 6278 - DNA, 125 bp, Zea mays
gttagtttaggagccacaaaaccggagagaattgaaggggctaaaatgtcatccttattcaattttaaataagaagaggattttagcctctctaacccctccagtttttagactctcaaactagc

SEQ ID NO: 6279 - DNA, 70 bp, Zea mays
cgacacccgggccgtgcttgggcctgagtcgtggtacaccgtgctgagcccgagcacggcccgtttaagg

SEQ ID NO: 6280 - DNA, 255 bp, Zea mays
aggccctttgtctctcagcggcaggctggtgcgggcgcaagttggtgtattgtactttgtactattgtacatggatcgaaatcgctttgccatgcagagccgcagaccgccgggctcacgaaaagggaggcagggcttctaaaaagactgcgcctgggcgtactgctgcatgcttgctttgtttggcgcatgccgcgcatctctggttcagggaatcagtccgcacacatgctgctcctgggcggctgggcctag

SEQ ID NO: 6281 - DNA, 198 bp, Zea mays
gctgactcagcgtgtccagcgagacgacaggtatcgtgtattgggcctgcgaacacgatggcccagtctgacaattccagcttcggcatcatcttggtccatctccgcatcttatccatcttccatcggaactctatccggctgctgatcctcctcaacatgttggctcacgtgttgtctgctgacattccccctatc

SEQ ID NO: 6282 - DNA, 214 bp, Zea mays
ctgccgattgcgtgccgtgcttgggccagcacggcccgacgaaaacccgtcgtgctttagggccgtgctgggccttacttctacccaccaggcccaatacggcacggcacgattctatttcgtgctaaccaggcccgactaactgaggcccgaagcacgacgggctcgtgtcgggccggcacggcacggcccaagttgcagcactaacactgag

SEQ ID NO: 6283 - DNA, 78 bp, Zea mays
gctgtttgctgtcgttgcagccattgcataaccataccagccggcgacgtgcaaggactagcagaagcggcacacgag

SEQ ID NO: 6284 - DNA, 153 bp, Zea mays
accaaatattcgggcactcggcaaagaagctatttaccgagtgccacgcaaaaaacactcgataaaagaaaacactcagcgaaaaagctttttgtcgagtattttgtttttgacactcggtaaagagtttctttgacgagtgtaaaaaatata

SEQ ID NO: 6285 - DNA, 171 bp, Zea mays
acttacccacgacgctcgatccggcgccggagcttcccagagtcatcgccgatggatggatcggcaagggtacgggatgaagaggaaggaaaagcagtggttgcggctgcacacaagtaaggctgaagcctggagagggaccgagactcggagagggcgtcaccgtcaggt

SEQ ID NO: 6286 - DNA, 81 bp, Zea mays
cgtcttctgttgcgcctagagaaggcccactatgtgtcctaccggacgtcttaccgggggcctctcaggcgacctatggag

SEQ ID NO: 6287 - DNA, 196 bp, Zea mays
cgcttactgcgtgccgtgcctgggccagcacggcccgatggaagcccgtcgtgctttagggccgtgctgggccttgcttctactcactaggcccggtaaggcatggcccgattctatttcgggctagccaggcccgactaattgaggcccgaagcacgacgggctcgtgccgggccggcacggcacggcccaagtt

SEQ ID NO: 6288 - DNA, 220 bp, Zea mays
cagttaaggactagtgctgcaacttgggccgtgccgtgccggcccggcacgagcccgtcgtgcttcgggcctcaattagtcgggcctggctagcccgaaatagaatcgggccatgccttaccgggcctagtgagtagaagcaaggcccagcacggccctaaagcacgacgggcttccatcgggccgtgctggcccaggcacggcacgcagtaagcgaaca

SEQ ID NO: 6289 - DNA, 199 bp, Zea mays
gtggtatttagggggtgtttggtttctaaagactaatttttagtccctccattttattccattttagtccctaaattgctaaataaggaaactaaaatagagttttagtttccgtatttgacaatttaggaactaaaattgaataaaatggagagactaaatattagtccctagaaatcaaacaccctcttaatgtttt

SEQ ID NO: 6290 - DNA, 191 bp, Zea mays
ctgaataaggggtgttggtttctaagaactaatgtttagtcccatcattttattccattttaatctataaattgtcaagtttagaaactaaaatatagttttagtttctatatttggcaattttggaactaaaatggtataaatgtatggactaaaaattagtccctagaaaccaaacgccccttaagtct

SEQ ID NO: 6291 - DNA, 237 bp, Zea mays
gattcgaagctgaggatatctgacgtggccttctcgttgagccacgctcacttgagcagatcgaggtgcgcggatttgttgcggcggcggtggggaggaggggtgggggatccgcgtggggaaggaccgcgggcgggattggacggcgtgggcaccattgaaaggaggaatcaagcgtggcgagcgggcgggatgcgacggagatagggcgcatgacagctattgcagagggagtgc

SEQ ID NO: 6292 - DNA, 207 bp, Zea mays
gtagcagtacaaaacaccttccaacagggcagccaaacgagccaggcaaaaaggatggaaagaggaaagtcataatagcttgtactgtggctggcagctatttcctttttctgtgtctgagaacatgaccccaccatctgcttcatttgttggactatactaccgctgcctttgtacctgtgttgttgaaagtgtgtgccatatgcc

SEQ ID NO: 6293 - DNA, 110 bp, Zea mays
gccgccgacgcgatcgagcactgcggcccgcgcgggctggcctcgccgacggccttgccgtacgtgcacgcacacctgcccagcggcccagccacgattgcccgcgctgt

SEQ ID NO: 6294 - DNA, 79 bp, Zea mays
gtagagttgaggtggcgggaggtcgaggccagagacgatccacgctaaccggtgcgcccatcgccaccatgcgtccgtc

SEQ ID NO: 6295 - DNA, 191 bp, Zea mays
agcacagagagtgtgggagagcaggcctccgaaaccgccgtccgcagagagacacttgcatggtgtgcgagcgatcaggtttttggagagcgtactcgcgtctgctcgcttcgtccgctcgaccagcactgataaagttcctcgtcgtcggcgccgttcgagggactgcactgcgtacatatgtctgtgtt

SEQ ID NO: 6296 - DNA, 203 bp, Zea mays
ggagacgatcaccaggttcgtctcgcagctggggtcctggtccagccgccccatgtcgatgtcccgccacagcgactcaaggaagcctgcgcaaacgcatgggttcgttgattggtgtgtcaataaataatggtgtggggaggagaagagaagagggagacgatggactgaatcggctcggctcggatcggatgatcgtactg

SEQ ID NO: 6297 - DNA, 140 bp, Zea mays
ttttattaagggctaatttggtgaccggggatcccgaggggaagaaatcctcttgctattcaaaattgaatggcaagggaattcctccccccatggatcctctagggatccctaatcaccaaatcagtcataaaagggga

SEQ ID NO: 6298 - DNA, 106 bp, Zea mays
ttcggattattcggtctattcgggttctcgaatctataccccgaaatatagcacgtatagaaactaaatctgaactcgaaaacctaaattgaccgacaattcagtt

SEQ ID NO: 6299 - DNA, 142 bp, Zea mays
aagagcctttagggctgatttggtgaccagggatcccgaggggaagaaatcctcttgctattcaaaattgaattgcgaggggattcctcccccatggatcctctagggatccctaatcaccaaattagcccttaggaggcta

SEQ ID NO: 6300 - DNA, 175 bp, Zea mays
aggccttcgctcgtgctgcgctgccttttccacggccccagccccaatcccatccagcaggtctcctgctgcctgccgggcaccggccgcaaccaacacaacggagctctagttttccagaagaagaataacccagatggatggaggcaggcaggcaggcagtgatcgatcgctt

SEQ ID NO: 6301 - DNA, 174 bp, Zea mays
actctcgcgattaagggacgatggagatttttgatgcgctagtagagagtccaggaactccgattgatacttttggattggtggcgttagagtctacgaggtggttcatctgaaaaaaaaaacaagtaaacaactgcctcctgtccctccctccctcccttaaaggtttgacga

SEQ ID NO: 6302 - DNA, 76 bp, Zea mays
cccacaaactgcgctcttagctactgccctgtagactcacagcacccgcgcagccagctactgcgcctgctcgtgc

SEQ ID NO: 6303 - DNA, 72 bp, Zea mays
ttgagcccatgtgagaacgaccgcgactggggctgagccctagacccgtcctttggcgtgggacagacgcgg

SEQ ID NO: 6304 - DNA, 154 bp, Zea mays
acatatgattttgttttgctcgaatgtggtagctcgtttagcttgcgagctggcttgttaacgaaccatgctaggatgtcaactcagctcgtaaaaaaattcaaacgagtcgatccgagctgaccataaaccgagcaagccaacgagccacgag

SEQ ID NO: 6305 - DNA, 164 bp, Zea mays
ggtttagtggatgtttagtttctagggacattttagtcattaaattgtcaaatactaaattgtcaaatacgtttagtttctatatttagtaaattaaggcttaaaatgaaataaaatggatggactacaaattagtccctagaaaccaaacatatttttcttat

SEQ ID NO: 6306 - DNA, 138 bp, Zea mays
actaggtgaatgcccgtgcgttgcaacggaaatatataatacaacgataacttatgtacaaatatgtaatatattgttatgagaaaaggtcctcaagcacttatttgatctgagcgacgacgatggagacttcaccgg

SEQ ID NO: 6307 - DNA, 97 bp, Zea mays
gtccaactccagcaacgccgtgtatgtggatgtgttgtactgtttgaaaagagtaattttaaataacgccgtgtatgcggatgtgttgtactgtttg

SEQ ID NO: 6308 - DNA, 254 bp, Zea mays
aatttacataactattggagttgctcttagctgccagccgtggtgacgtataacgaatgacgacgctcgttttcttctggagaggcttcaaagtcttagattgggattttttttatatatgatcatcgttggaatacgctctgatctggctgaataaaggcataacctccctggtaactagagagacgagaaaaaaaggcaggagcagaccgctattgggctaggctaagaccggtccagcagttacatatatg

SEQ ID NO: 6309 - DNA, 125 bp, Zea mays
atagcttcataagggctgatttggtgaccatgcaattggaggggatccatggtgtaggaatcccctttgctattcaaagtatcccttttaattttctggtcaccaaatcagccctacgtatgggg

SEQ ID NO: 6310 - DNA, 125 bp, Zea mays
ccccatacgtagggctgatttggtgaccagaaaattaaaagggatactttgaatagcaaaggggattcctacaccatggatcccctccaattgcatggtcaccaaatcagcccttatgaagctat

SEQ ID NO: 6311 - DNA, 144 bp, Zea mays
cagatttagggtatgtttggttcgctgcctaacttgccacactttgcctaacttttctgcctaaagttagttcttcaattcggacgactaaccttaggcaaagtgtggcacaattagccacgaaccaaacagacctttagtttg

SEQ ID NO: 6312 - DNA, 240 bp, Zea mays
cttaaagtattgaggcagaactgtgcaccacggtatgttgtggacgactacactaaggccttaaggagtagtagagatagagatatcttaagtccaggaaccctgtttggaacgttggttttacttccggtagtttcagaaatttagaactgacaaaactgtaaatctctactgctctataagatgatagtgtagacgtacacacattttggtgcacggttctgcctgcagtcgcccgct

SEQ ID NO: 6313 - DNA, 97 bp, Zea mays
cctgttcttgctcgcgagctaaacgagccaactccagctcgtaaacgagccgagtcgagctgactctatggctcgttagctaacgagatgggacgag

SEQ ID NO: 6314 - DNA, 77 bp, Zea mays
cggattagctagcgggccgtgctgtgccgacccacgggtcccaaacgaggcccaaacacgacccgctagattaataa

SEQ ID NO: 6315 - DNA, 112 bp, Zea mays
ttcatcagtgcgatggcggacttgttgtccaccttgagcttgggagcgagcactgctcctccgatgagctcagccagcagccgtgccaaccagactgcctcgcacgcggccg

SEQ ID NO: 6316 - DNA, 255 bp, Zea mays
  unsure (162)..(163)..(164)..(165)..(166)..(167)..(168)..(169)..(170)..(171): n = A, C, G or T
ccttggtggagcagcggctgctggctcccgcggcgcgcagtgcagccgcccaggccgggcgccgtcgacggttcacaggaatagattagattagatcagatccgaacacatatagcttaggtttcggtcctcggtttcgaatagcgggatgggcgtacccannnnnnnnnnaccttgcaggtggacgcttgtcaccggaacaccagacgcagggcacagagcggtggcggcggatcagcggccgcccagttacgc

SEQ ID NO: 6317 - DNA, 162 bp, Zea mays
cgaatttctggcttggttaaaaaatcctctccttgtgtctcgcccgctcctggttacgtcctgcacgccaccctctggctgggccgttgagtgggcggtgacgacccgctagtgatagtgggccagggtttggggattttctcggccgagaccatgttccgg

SEQ ID NO: 6318 - DNA, 112 bp, Zea mays
tctgaaagtatctttcgaagggtttaaagaaagtcccgctacccgatttactagcgcataccaactccccaagttctccccctgaagacccctgcgaaaggagacattcaac

SEQ ID NO: 6319 - DNA, 138 bp, Zea mays
tcaaacccgacgggttcaggtgcgggtttagaattgcactcgtgggtacgatcgtgggtgggtttatatagactttaaggatgccatcccgggtagaattttgctcaactcaacccgaacctgacccgttttcatcct

SEQ ID NO: 6320 - DNA, 255 bp, Zea mays
tggttgaggatgatagtgagcgttgcggtacgctactggagaacgagcagaaagagagaccgaggagacggaatagagaaggcgtgaggtagaagaaagagagctgtagcagtcaagtgtaatttgtactctgttcttttgataagctctctcctgctacaaggtaacatataagtacacggacgcaggcgctccccaccgcacacaccgtgtcctaggctcgcgcacgcaggcgcacttgtcacacgcattaca

SEQ ID NO: 6321 - DNA, 222 bp, Zea mays
aagacaggacattaagggtgtgtttggttgcgggacagccaggacagggacgtcccctggcgttctctctcgtccctccaattttgagggataactggggacaacactgggatagtcctgtcccaacccctgaccctgaaccaaacaaccctatttgaggaatcgtctcgtctcatcccgtcctgtcattgcaaccaaacgcaccctaagtaccttgagacc

SEQ ID NO: 6322 - DNA, 131 bp, Zea mays
gatatagtgcatgtttggtttgtggctaacactttgcctaacattagtccttcgaattgaaaaactaactttagatagaaaagttagacaaagtatggtaaattagacagcgaaccaaacaaagcctataa

SEQ ID NO: 6323 - DNA, 97 bp, Zea mays
gggtcgaaggcaggcactcggcaaagaagattctttgccgagtgtcagttagatgacactcggcaaagacctctttaccgagtgcctttttttggca

SEQ ID NO: 6324 - DNA, 123 bp, Zea mays
gaccgcaccctccatatctaacggtgttgcgtctattttgtaaagaagcctctacactcttgctctgtacattttacaaaaacctcccctgacgcagcaccattggatgtggagggtatggtc

SEQ ID NO: 6325 - DNA, 159 bp, Zea mays
ttgtaccaagcttgactggctcgtcttattcaaacatttttgcaaaaagatgaaaaattcagagctatacttaaagtgtatttaatgctaaacgataacacaataaaattaataataattatattttttaaataagataagtcaattaaacttagtgta

SEQ ID NO: 6326 - DNA, 165 bp, Zea mays
gctggtgtcttcggttttgctggtgtgctcatttttatcattagtcgtgttttttgttcagttttgttttgtccttctgttctatagcactaaaagggtaaaattgagtaaaaaaacacaactaaggataaaaataagcacatcagcgaaattgagggcaccctc

SEQ ID NO: 6327 - DNA, 176 bp, Zea mays
  unsure (51)..(52)..(53)..(54)..(55)..(56)..(57)..(58)..(59)..(60): n = A, C, G or T
gtgttattccaggcaagccccggtgcatgcaaccccttctgttggtaagtnnnnnnnnnnagtttagcgaaagttttagaagtcctaattcaccccccctcttaggcgtcacccgtttcctacaatgagccacgagccaacaaggaccatgtcattgtcgcatgttggagcgaagg

SEQ ID NO: 6328 - DNA, 117 bp, Zea mays
atgatgttcgccgctactgttttgtttggagaatgtaaacatgttctactcgacagtttccaaatggccacagggcacccaaaacccaccggacagcacagagacggggaaattatt

SEQ ID NO: 6329 - DNA, 143 bp, Zea mays
ctacaactataagggctgatttggtgattagagatccctaggggatccatggaggaggaatctccttgcaattcaattttgaatagcaagaggatttcttcccctcgggatccccggtcaccaaatcagccctaaaaggacat

SEQ ID NO: 6330 - DNA, 152 bp, Zea mays
gactctagaggatccccacactgtgctgtgagtccacgagtaattgttagtagataaaaaattgatagtagatatagaaaatgatattttatagttgtagtggggtatagggggagtatttagggggaaccgctgcgggagataaaagaata

SEQ ID NO: 6331 - DNA, 164 bp, Zea mays
gctggaacaacacccttagggcccgttcggttgtatcggaataaaccaagattcatttcagttcatcaaaatctatataaattagagaagtaatccggctaaaaaataatccggggctccaatccctgacaaccgaacagggccttagggcgtgttcggttata

SEQ ID NO: 6332 - DNA, 123 bp, Zea mays
atgcttaattgtattgccgaagccactggtaccttcattcccgtgtcctccctgctgcttgatatgcttgaaatgaaagaacttagaggacgtccagatggtgttggcaaagccgtgaatttg

SEQ ID NO: 6333 - DNA, 87 bp, Zea mays
caaaggtgacactcgacaaagcgtactgtgccgagtgtcagcctaggtaacactcggtaaagtttgttttgccgagtgtcttacggg

SEQ ID NO: 6334 - DNA, 108 bp, Zea mays
ggttcacggctaactgtgtcacactttgcctaaggttagtcgtccgaattgaagaactaaccttagttagaaaagttaggcaaagtgtgacaagttatgcagtaaacc

SEQ ID NO: 6335 - DNA, 178 bp, Zea mays
gtgcctaggggctaatcgtgccgtgcccgtgccggcccaacggccctaaaccgcggcccaggcacggcactacctatcgggccggcccggaaagggcccgacatcagccgtgccgtgccgtgcccaggcactacgggccgtgccgtgctccgggccggcccgtttagcccggcacgac

SEQ ID NO: 6336 - DNA, 103 bp, Zea mays
tctttctcttgtgtgacttagctcgccgaagtcggacaagggcagaccaccacgtttggtcggccggttcccgcccgctgggttggggaagacaaaggggagg

SEQ ID NO: 6337 - DNA, 180 bp, Zea mays
acggccgcctggggaaccgtcagacataagcttatatccgacggctactggcggccgtcggacataatgcgggacatccgagggctggcagacaggcagtcggacataagcttatgtccgacggctggcagacaggccgtcggacataagcttatgtccgacggtctcctaggtgcccgt

SEQ ID NO: 6338 - DNA, 151 bp, Zea mays
tactaggtgggtgcccgtgcgttgcgacggaaccatataataacttatgtacatataggtgagtgcccatgcgttgcaacgaggatatataatatcacggtaacttatatattatatgtctccgttgcaacgcacggacactcatctagta

SEQ ID NO: 6339 - DNA, 154 bp, Zea mays
atatactaggtgggtgcccgtgcgttgcgacggaaccatataataacttatgtacatataggtgagtgcccatgcgttgcaacgaggatatataatatcacggtaacttatatattatatgtctccgttgcaacgcacggacactcatctagta

SEQ ID NO: 6340 - DNA, 90 bp, Zea mays
cggtgggtccagggctgggaagacactcgcattctctagcccttctcggattgacgcctggtgcgtgtgtctctcggtttggagctgctc

SEQ ID NO: 6341 - DNA, 124 bp, Zea mays
gatatatacatgtatgaccgatgaaaattaatactaactacgttcttaaatatttatcgtccgctagttcatttctatactatattaaagtatcagtttcaacggtcgtcacactttatctttt

SEQ ID NO: 6342 - DNA, 205 bp, Zea mays
gtgcccgccgcgcggggcagcgccgcgctctaccggcccgcgccgccgcccgcggacaccgccggccaccactacctcgccgcggcgcggccgggcgtggcctaccagacggggcagcagtacgggttcggtgaccagctgggctcgttcggcctcagcggcgcgccggcgcagagcggcggcggcggcttcgcgttctcttccg

SEQ ID NO: 6343 - DNA, 189 bp, Zea mays
ggtgcgtttggttgcgggacagccaggacagagacgtcctctggcgtattttcttgtctctcaaaatttgagggataactggggacaacactgggatagtcctgtcccaacctttgaccctgaaccaaacaatcttattcgagggatcgtcccatcttgtcctgtcctgtcattgcaaccaaacgcacc

SEQ ID NO: 6344 - DNA, 192 bp, Zea mays
gctttagggggtatttggtttctagcgactaatgtttagtctctacattttattccattttagttccaaaattgctaaatatagaaaataaaactttattttagtttctatatttagcaatttatatactaaaaaggaataaaataaagggactaaacattagtccctagaaaccaaacagccccttagtca

SEQ ID NO: 6345 - DNA, 200 bp, Zea mays
ggcacgtaatgggcctgtttggtttgtgtcaaaatgtgtcacactttgtctaagactagtcgtccgaattgaataactaaccttaagcataaaagttagacaagatgtgataagttagtcagtaaaccaaatatatcctatatgtcctcgctcggcatgacctatcccggacacgaattaggcatggcccgaattaggca

SEQ ID NO: 6346 - DNA, 236 bp, Zea mays
tttgattagctggaacgattccggttgcaatccggcacaaacaaacaaggtctaagggcctgttcggttattcaggaatctactccaggaaagattccaactggaataattgtataatttgtagtataaattggtaacctgaaatagttcctagccttttccagcctaaccaaacagtgtctaaggtcatgttcgttttggttggattgcacccagaatcgttccagctaatcaaa

SEQ ID NO: 6347 - DNA, 77 bp, Zea mays
tacgcgctacgatgtgagcgtgatgactgggcagtgggcaacatgtgtcgcgtggtccgtgtgcgtcgggcgtccgt

SEQ ID NO: 6348 - DNA, 188 bp, Zea mays
aaaaattttggtacagcccgaatgcaaatcaggtgtttacatcctctcacaaaaaggaggacatatctcacctgcaaatccaccaaataacgttttagttgttgttgctgctgcgggtgaggtttatccttctttttgtgaggggttgtaaacacgctggtttgcatccgggctgcaccaaatttttt

SEQ ID NO: 6349 - DNA, 73 bp, Zea mays
attctcttttggtgttgcgacaccgtctattggactattggactgtatatcgtgttgaagctcattagaggta

SEQ ID NO: 6350 - DNA, 101 bp, Zea mays
ccgtataaaaaggcaggcaggcaggcagagcggggacgagcaagcaagcagttgcagttgcagcggcctcctcctctgcttcctccctcctcctccacacc

SEQ ID NO: 6351 - DNA, 174 bp, Zea mays
  unsure (52)..(53)..(54)..(55)..(56)..(57)..(58)..(59)..(60)..(61): n = A, C, G or T
ggtgcgggatgggagagggtccggacgacggttcccagtggtgatggacgtnnnnnnnnnnggccgcgtatttagtatttacatactatggagagaattaaatgtatttacatatttagtatttacataaatatgcgggccgccgtcgtgccgacccatttatcgtgccgggcc

SEQ ID NO: 6352 - DNA, 150 bp, Zea mays
ctcctcccctgagggctagtttgggaggctcaaagcccagaggattggaggggattttagcctcttcttattcaattttaaataataaggagattttagcctttttaatttattccggattttagacttccaaactagccggaagcggcg

SEQ ID NO: 6353 - DNA, 111 bp, Zea mays
gtccgagcgccgtgagttctccgctgctttccgccgcccaaaaaccgccgggaaggcaaaaaagatacgccctttgcggcgaagctccggggggccttgtggccctcggct

SEQ ID NO: 6354 - DNA, 209 bp, Zea mays
  unsure (120)..(121)..(122)..(123)..(124)..(125)..(126)..(127)..(128)..(129): n = A, C, G or T
  unsure (138)..(139)..(140)..(141)..(142)..(143)..(144)..(145)..(146)..(147): n = A, C, G or T
gtaagtctgtctccagcaacgtcctctatatccatcatctttatccgtcctttacagtctcctctaaaagattctatcatctatatctccttcatctccaacaacgtcctctaaatcacnnnnnnnnnnaccttcctnnnnnnnnnnatttgatcctctatatttatggtacagaaccctttagagtcttttgctggagctagcctaat

SEQ ID NO: 6355 - DNA, 73 bp, Zea mays
tcgcaatccaagtagcaacagacgtcttatttcccattgtacaaattcgtcgtctgttctattgatttgatgt

SEQ ID NO: 6356 - DNA, 220 bp, Zea mays
  unsure (178)..(179)..(180)..(181)..(182)..(183)..(184)..(185)..(186)..(187): n = A, C, G or T
aagtagcccgcgcttggggtcgacttggcttgtctttcgcatcacgtggttaattcacgtacctcggttatgccttggtgtggaggtaaacaagacatcgtggcacacggaataagctcagggcgacatcagaaacactggactcttgttgcaaagtcgaggtgatatttgagacctnnnnnnnnnntttgagacgaagtcgatgttggccggtgttaca

SEQ ID NO: 6357 - DNA, 191 bp, Zea mays
gctaaaatttagtctctgtcccatcgaatgtttgaacctctgttccgggtattaaatgtagtcggattataaaactaatttgtcagccgaagattaaaagacgagacgaatctagtctagttggttgggtctatatttcatactcctatttaaaagtaaaacgcttgatgtgacccggactaaactttagc

SEQ ID NO: 6358 - DNA, 151 bp, Zea mays
caccgcatttagggtctgtttggttcgctgactaacttgccacattttacctaacttttctgcctaaggttagttcttcaattcgaacgactaaccttaggcagagtgtggcataattagccatgaaccaaataggcccctaatatgtcga

SEQ ID NO: 6359 - DNA, 131 bp, Zea mays
tagggtctgtctggtttgctgcctaaggtgccacaatgtgcctaacttttctgtctaaggttagttattcaattcgagcgactaagcttagacaaaatgtgtcgccttaggttgaaaatcaaacagacact

SEQ ID NO: 6360 - DNA, 127 bp, Zea mays
aacatcccccgcggttgcaacgggagcaccgtacacgatgagactggagtagaagctgaagttaggagccgatgggttcaaatcaaccgcagttgtgagggtgcgaatgttgcgcctggagtaggga

SEQ ID NO: 6361 - DNA, 157 bp, Zea mays
acgcacgcattatgggccctgtttggtttgtggctaaatgtgccacactttgtctaaggttagtcgttcgaattgaataactaaccttaggcagaaaagttaggcaaagtgtggcaactgaggtagtgaaccaaacaggccctatatacgcgcggct

SEQ ID NO: 6362 - DNA, 195 bp, Zea mays
gttgatgggccacaactctggcccggcacagacaacacccttttcccatcagagcataggttcgaaccccatcttctgcactatttttaacattttacgctgatttaatcaaatgagctgatgggctaacgggatggctcgacacagtcagcaggccggtatgacgtgcctgagccagagttgtggcctgtgtcg

SEQ ID NO: 6363 - DNA, 83 bp, Zea mays
tccattggccagaggctgttcaccttggagacctgatgtggttatgagtacgaccgggcgtggacggtattctgccttccttg

SEQ ID NO: 6364 - DNA, 191 bp, Zea mays
taggtatatgcccgtgcgttgctacggaatcaatacgataaaatccttcacccaatgcacatgagacaatattgagatgtaccaaaaattgtaatgttaataccttaaaaccactaattcagatgccctttaagctgcaagtgattgggtgaagggcatatgcccgtgcgttgcaacggggacacttatac

SEQ ID NO: 6365 - DNA, 106 bp, Zea mays
acccgcgggtgtggtcgcgggcgggtttgggcttattccgcgggtgcggtcgcgggtgggttttttctccacccgacccgaacccgacccgttgccatctctacca

SEQ ID NO: 6366 - DNA, 133 bp, Zea mays
catccaccgcagtcgcaacagggccaccacacacgatgagactaaaatagaagccaaaggtaggagacgactggttgaaatcccccgcagtcgcagtgacgtgagggtgcgaatgttgcggctggaatagaga

SEQ ID NO: 6367 - DNA, 192 bp, Zea mays
tacttagggcatgtttggttccatgagactaaactttagtccctcttttttagtctcaaaattaccaaagataggactaaaaagaggagaggaaatcagattgatttccttttagtccccatatttagggactaaaatagactataagggactaaagtttagtcctatggaaccaaacatatagtcctagac

SEQ ID NO: 6368 - DNA, 85 bp, Zea mays
cgttgcaggtagctcggcgccaagatctatggcgccgagatgtgtaaactcggcgccatagctcatgacgccgagaaatgggtcc

SEQ ID NO: 6369 - DNA, 126 bp, Zea mays
gcgtgttcgctgcggctgcaatccggctgtggctgcggcttgtacagtatttttctctctatggattgcagctgcagcaatccaaacagctgcaacagtgtcggcttgcagccagccgaacacgcc

SEQ ID NO: 6370 - DNA, 157 bp, Zea mays
catttgtgactagatgagtgcctttgcgttgcaagaagaacatttatcatgaagaacatttatcatgataacttatgtacaaatgagttataatgttataagttatcgtgatatatgtttccgttgcaacgtacggacactcacctagtagagatat

SEQ ID NO: 6371 - DNA, 198 bp, Zea mays
cacttatcctggtgcaagcatgcaatcaaacgatctggtgcatccgatctagatctaatgatgactgttattttatatttaaccccttccacttaaaacatagtacctattttacttttaaccccttccatatgaaaccgttggatctagattggatgctctggatagtttgattgcacgcttgcaccaaaatgagtg

SEQ ID NO: 6372 - DNA, 147 bp, Zea mays
aaagacgtacaccgaccgaccgaccgacctgctgggtcgacgaacgaccgccgccatctctggactcgaccctacctatcgtggattcgtggggggtcgacgaagactgaatagctagcgtgtggtcggccggacggaaccggacaa

SEQ ID NO: 6373 - DNA, 149 bp, Zea mays
ctctatcaagcagtccacagaagcagccaggaagaagggagcctggaagaagggagcggcgtcctaacgtccgactggtgggcccggaatgggcgtgaatgtgcgccatccgtcgcgtgtggctgtgtgtgtggggctgcgtccccgtg

SEQ ID NO: 6374 - DNA, 88 bp, Zea mays
ctctctcccgactcggcggcgattgacttggcgattggcgattcccctccgatgcctccgtcgcggcgccgcccctgtccagcgacct

SEQ ID NO: 6375 - DNA, 113 bp, Zea mays
tccaactaggtatatgctcgtgcgttgctatgataaaacacattgatatgtaaaaaatatcgtgttttataatattgactccgtagcaacgcacgggcatatacccagtaatt

SEQ ID NO: 6376 - DNA, 128 bp, Zea mays
gaatcgcgtttttttgacactcggcaaaacttcttcgacaaatattttatcggcaaagagttatttaccgagtactatttttcggacactcgacaaagattttgccgagtgtcaaaaagctctcggca

SEQ ID NO: 6377 - DNA, 94 bp, Zea mays
taggctctcccagacgccacaccgcgccacactctggtgtggcgctcaaatcggccgccgcaccttaggcgtggtgcggcgccgtaggtgccag

SEQ ID NO: 6378 - DNA, 158 bp, Zea mays
ttacatcctggtcggtcggtcggtttgtcggtcgatacctggatcatgttgtcgtcggagcccagatatagccgcccggccgcgacggacgacggatcgcacaacgaacgccggcgcggcggcagatgagccgagccgagctgagctgggagaggtgt

SEQ ID NO: 6379 - DNA, 84 bp, Zea mays
cgacggcggcgtcttcgcacggatcgaccgggtcgccgctccgcgaagctgcccagtggatccgcgtggacgacggcgtctgct

SEQ ID NO: 6380 - DNA, 173 bp, Zea mays
gacgacgctgcccaaggcgtccagcaccgtggtgtgctactcgcccatgatgataaccaccaacggcatctggcaagggttcaacccgctcgagttctccctcccgctcttcatcctccagacggccgtcatcgtcgtcaccacccgcttgctcgtccttgtgctcaggccct

SEQ ID NO: 6381 - DNA, 157 bp, Zea mays
cagatacactgaccctgtggggctgtggctaactggagtatttagactgtgttcagcggttccctctaaatttctccccctatatcccactcacgtgccacgtcagcgttctctttccccctttttctccacgctctacagcggttccccctatatc

SEQ ID NO: 6382 - DNA, 205 bp, Zea mays
attgtgttctaagttacggccgcgcactgttcatagagcaaataaaaataaaacaaatattggatggtagttgagttagttgatgatgaaagtataaaatattggtgtggtggggtatagaggtttgatatagggggaaccgctgtagagcgtggagaaaaagggggaaagagaacgctgacgtggcacgtgagtgggatatagg

SEQ ID NO: 6383 - DNA, 128 bp, Zea mays
agcaacttggctgatttggtgaccaggaatcgtggaggattgaagaggatcaagaggtaaattggttcattttttcctcaatccatttcaatacctccgtgatccttatcaccaaatcaactctaagg

SEQ ID NO: 6384 - DNA, 119 bp, Zea mays
gcgcggctgctggctcccgctgcccgccggtcgcacgcggcgcgcagtgcagcctccgggtccgagcgccgtcgacggtccaccggaggcaggaggggagcgggaggcgtgcacgcagg

SEQ ID NO: 6385 - DNA, 198 bp, Zea mays
catttatattggtgcaagcatgcaatcaatcaatccggtgtatccaatctagatccaatgatgaatgttactttacaggtaaccccttccacttgaaacctagtacctattttacttttaaccccttccatatgaaaccattgaatctagattagatgttctggatagtttgattgcacacttgcaccaaatgagtga

SEQ ID NO: 6386 - DNA, 199 bp, Zea mays
gacagactaagggggtgtttggtttctagttactaatttttagtccctcaattttattccattttactccctaaattactaaatatagaaactaaaactctattttagtttccctatttaacaacttatgaactaaaatggaataaagtggagggactaatgtttagtctctataaaccaaacaccccctaatttaatt

SEQ ID NO: 6387 - DNA, 156 bp, Zea mays
taagtaggcattatgggcatgtttggttcgttaccccaattgccacactttgtctaacttttctgcgtaaggttagttattcaattcgaacgactaaccttaggcaaagtgggacacagttagccacaaaccaaacaagccctatgtgcaactatg

SEQ ID NO: 6388 - DNA, 83 bp, Zea mays
aaaaccgggattgaaggagctataatcaccttcttatttaatttgaataagaaggtgattttagcccctctaatccccttcag

SEQ ID NO: 6389 - DNA, 118 bp, Zea mays
agtttaggagccataaaaccagagtggattaggggactagatttctcctcttattcatttttaataaaaagtgtaatctaggccttccaatcccctccggttttctcgctctcaaact

SEQ ID NO: 6390 - DNA, 103 bp, Zea mays
aaacaaggcaaagggctgatttggtgacaaagtaaagcaagggattttcttcctatagatccccttcaattcctttgtcaccaaaccagccctatgtctcttc

SEQ ID NO: 6391 - DNA, 150 bp, Zea mays
ctgctgcttcaggccttgttcgtttacatcggattgcacccggaatcgttccagctaatcaaagtttatataaattagagaagcaatccggctaggaatcgttccgacccatcaatccgacacaaacgaacaaggcctcaaagttttttg

SEQ ID NO: 6392 - DNA, 140 bp, Zea mays
acggcctcctacaggaccgtcggacataaggttatgtccgacggccgcaaccggctctcggaaatagccctcatgtccgacggcctgctcttatgtccgacggccctgtgcttatgtccgacggtcctgtacgaggccgt

SEQ ID NO: 6393 - DNA, 184 bp, Zea mays
tcggacataaccttatgtccgacggcctcgtacaggaccgtcggacataagcacagggccgtcggacataagagcaggccgtcggacatgagggctatttccgagagccggttgcggccgtcggacataaccttatgtccgacggtcctgtaggaggccgtcggaggtaagggggccgtcagac

SEQ ID NO: 6394 - DNA, 80 bp, Zea mays
tttctacgtgattggatgcctgctgctcggcagccaggctgtgtgcgtgcgttgactgaccagcagcacctgattgaatg

SEQ ID NO: 6395 - DNA, 215 bp, Zea mays
ccgtggccgagtggaggcaggaagacgagcagcaagctagcgacagtgtcctgacagctggcgatgacggttgggtgggcggccaacgatgatgaactgactgttggacgtcaattggacagcgggcacaacgctaggacgagcgctaagcgggggttggatgctacaaacgtgcggttgatgcctttctcattctgtgttttattcgatatagg

SEQ ID NO: 6396 - DNA, 232 bp, Zea mays
aaaatcgccccccaatgatccccaagaacgacaggattcgatttccgaaatgcaaaatcacaagcaaacaggaatcaatcaagaacgtagggcgtggaggaagggggaagggggcttgtagagctcggacctctggttctcaaggcggagggagggcgtggatgaagaaggagcttgccacctgcggagctcgaacctttggttcttgggggccgattggcggccgcggcgg

SEQ ID NO: 6397 - DNA, 87 bp, Zea mays
tgataattagagcacggcccagcccgcgattcgtgtcgtgctagcccgattttaaatcagccgtgtcgggccgtgctttgttctttt

SEQ ID NO: 6398 - DNA, 89 bp, Zea mays
aaaaaagaacaaagcacggcccgacacggctgatttaaaatcgggctagcacgacacgaatcgcgggctgggccgtgctctaattatca

SEQ ID NO: 6399 - DNA, 171 bp, Zea mays
catagaccgcggtgcacggttctgcctataggtgtacatttgggttgggtctgatgggccggcctgaagcacaggaaaaaagcacggcccaggcacggcacaactcgatatatcgggccggattcgggccgaggtcgcgacccatgggcgggcacgagcacgatccgttta

SEQ ID NO: 6400 - DNA, 86 bp, Zea mays
gatcctctagtgcaggctctggtgctggatccggggctacctcctgagcagctccttgctccggcacgaggacgtactctccgtca

SEQ ID NO: 6401 - DNA, 116 bp, Zea mays
cctttgttgtaccccatccgctctcgggttgcgatgtcctgtgcaccaccctctggttagactgttaccgagtggacagttgacgccgcccggttagtgatagggggctagggttc

SEQ ID NO: 6402 - DNA, 143 bp, Zea mays
tgtttggattgacatatagggcatgtttggtttgctgcctaacttttctgcataaggttagttcttcaattcggacgactaaccttaggcaaaatgtgacacagttaggcacgaaccaaacaggcccatagtccgcaagcttc

SEQ ID NO: 6403 - DNA, 130 bp, Zea mays
ttgcggactatgggcctgtttggttcgtgcctaactgtgtcacattttgcctaaggttagtcgtccgaattgaagaactaaccttatgcagaaaagttaggcagcaaaccaaacatgccctatatgtcaa

SEQ ID NO: 6404 - DNA, 104 bp, Zea mays
ggccaggaatcgatccggaggagacgaggccagggtttgtgccggtccttggagggaagagaaagcaaaaccgggccgagtttacttccggttcaggcccaaac

SEQ ID NO: 6405 - DNA, 250 bp, Zea mays
cgcggatgccgcccgggtgggctcgtgggcaagtaaagccccccgcgcccgcggcccccaccggcgtggacgtacgcgcgggcagcctccactggatccagggtgcggccagccatggcggtggcgtgtcccaaaactacccacatttacgccgcggacgcgccgtcctcacagccagccgagccggcccgttggttcaccacctgctgtccgtgccgtgcccgcccgcccgcccgaggctagctgccat

SEQ ID NO: 6406 - DNA, 229 bp, Zea mays
tttatgcaattttgcaagggggatgctgccgaaattttatatatagatgtcagaagtgttgtttagtagcattccggggtgtttgtggaccctggggtgttacagttggtatcagaggataggctttagattctacgcaatttgaagataaatttgacacacttgcacatataggaagggtatgggttcgtatctctttcatattagtattttattgtatagatgacta

SEQ ID NO: 6407 - DNA, 171 bp, Zea mays
cgtttcttcaggaatagccctggaatttttcaggttgatcaaaacttacataagggcttgttcgtttgtgccgaattggtgggtcagaacgatttctaaccggattgcttctataatttatataaactttgattagctggaacgattccgggtgcagtccaacacaaacga

SEQ ID NO: 6408 - DNA, 158 bp, Zea mays
actaacagaatttgggttttgttggggtttctagaacgaacttagaacgggattagctaagatcacaaccacaaactgcaccgacatggcgtaagttgtgatcttaggagtatatctcacccaccaacaaatcccaacagcaccaagaacacaagaac

SEQ ID NO: 6409 - DNA, 124 bp, Zea mays
tggtcgttagagctcggctcggctcgctttggattgataatgtaatgaattagattggttcgactcggcttggattgttaaagtaatgagttacaaaggatgttgggctcggctcgttacatag

SEQ ID NO: 6410 - DNA, 212 bp, Zea mays
cagagagctgcgcggcggcggccggcgggcgcggaggaggaggaagaagaagagggcgatgaatcgatcaggtaattagaagttacctggcggctgcgacgacgaggaggaggttggaaacccccgggcggcggccggacgcggcctcccacaggaacgccgaccacctcatctctgcctctggctggctggctggctccggtgatctcgga

SEQ ID NO: 6411 - DNA, 249 bp, Zea mays
ctcttttataggccctgtttgggatggctccaggttccagctctagtgtgttgctgtagtttataatatcaatttaaatagtttgaaaatatttttaatctaaataataaaagaaatgacttatctaaatgtcttctaatgacttacagctccagctccatgattttctggagcacctaatgacctgctccaccagttctaccaatttttttggagctggagctatcccaaacaggaccataaaatgat

SEQ ID NO: 6412 - DNA, 252 bp, Zea mays
tgtatatggaagggattaaccgaatagactttttgagatatggattaaatcataaagggattaaatcccaaggggattaagtggaagggagggatccactcaatccctctctggattagatccacttaggccctgttcgtttagcatgttcccggcagggatgagggccaaaaccccgtgacttgaccctgcttggaaagaaacccgatccagaaaaaaatgtgcgttcggttaagccctgagtaggtcata

SEQ ID NO: 6413 - DNA, 121 bp, Zea mays
caaagcgtgcctctttgccgagtgccagggccacaacactcggcaaagaagctataccggtgcccaggttttgcttctttgccgagtgctatgaccatgacactcggcaaagcacctcttt

SEQ ID NO: 6414 - DNA, 79 bp, Zea mays
actaggtatatgcccgtgcgttgcaacggagacatataatacacaagtccccgttacaacatatggacactcacctagt

SEQ ID NO: 6415 - DNA, 237 bp, Zea mays
tgctgccgccgctagacgccttctccgccaccttcttgggcaggagaaccgggttgatgttggggaggacaccgccgtgcgcgatggtgacgccagccagcagcttgccgagctcaacgtcgttgcggatcgccaggagcacgtggcgcgggacgatgcgcgtcttcttgttgtccttcgccgcgttgccggccagctccagcacctcggcggcgaggtactcaagcacggcggcga

SEQ ID NO: 6416 - DNA, 80 bp, Zea mays
tcgccccctcgctgcgatgctcgtgcaccgacctccgcctcccacccgcctcgcttgcatcgctcgcagtgccccaccac

SEQ ID NO: 6417 - DNA, 210 bp, Zea mays
ggaaaaactcttattgctcgtgctgttgcagacgatactggagcctttttctttctaatcaatggtccagagatcacaaaatttatatgtatagataggatcaccaatggattacaaatttttttctcataacaatataacacattatatataagttatcatgatattatatgtttccgttgcaacgcacgggcactaacctagtaatcg

SEQ ID NO: 6418 - DNA, 91 bp, Zea mays
gagtgggctggccacggtggccgtagctctggcggcaatggcgggcggaaatatgctcgccggagctaaggaacggtggctggccggtgag

SEQ ID NO: 6419 - DNA, 105 bp, Zea mays
attagtaatcgtgccgtgccgtgccggcactagtgcctaaccagcggcccaggcactacactatagtgcctaatcgtgccgtgccggcactatacggcactaata

SEQ ID NO: 6420 - DNA, 147 bp, Zea mays
gtaaaccagcctgtttgcagcccctcataaaaaagagaatatgtctcacctgcagactaataacacaactaaaacgttatttgatgaatctgtaggtagggtctatcctccttttttgtgaggggctgcaaacagagtggtttgcaa

SEQ ID NO: 6421 - DNA, 184 bp, Zea mays
aagagtgtgtttggttgcaatgacaggacgggatgatccctcaaattaggttgtttgtttctggatcaagggttggaacaggactatccagtattgtcccctgttgtccatcaaaattggagggacgagagaggacgtcaggtgacgaccctgtcctatctgtcccgcaaccaaacacacccta

SEQ ID NO: 6422 - DNA, 95 bp, Zea mays
tacagaaaggcgggtgaagcggccacatcgacgcgtcattgtggtgagtctgccttagatgacgatgatgaggcagcaacatgcgagaggcagcg

SEQ ID NO: 6423 - DNA, 190 bp, Zea mays
caaggtccgacacccccccccccccccccttctccgtatccttgacattttgttcggttggatccagtagccgggagattcggaatcccgcgcgcgagttgggcctagccagctggcgtcgtagccgcactctgggaggcatgtgggttcgagccgcggagggtaggggtaggggcgggtttcagttgtt

SEQ ID NO: 6424 - DNA, 119 bp, Zea mays
gaggggtgcaagtggagccgtcgcaccgggcgtccgattttggaagggccccaagtaatgtacatgtatatataatcttaggtgttgtgtccagtacggttgctccacttatccctctt

SEQ ID NO: 6425 - DNA, 135 bp, Zea mays
taagaacatgggtaccgtcgaacttaatgttaagaacgtgggtttttaagttcgataggggccgtcaaatttgttcccacaagttcgacggcacccacgttcttaaccttaagttcgacggggccacatggtcgt

SEQ ID NO: 6426 - DNA, 62 bp, Zea mays
actcggtaaagcttcctttgccgagtgacagctgcgcggcactcggcaaagaagcatctttg

SEQ ID NO: 6427 - DNA, 81 bp, Zea mays
tgccacggctacagcactcggcaaagaattttgcaccgggttccaagtgtgctttctttgtcgagtgctatggtcatggca

SEQ ID NO: 6428 - DNA, 250 bp, Zea mays
  unsure (23): n = A, C, G or T
gttagaataagggggtgtttggnatggcttcaggttccagctccagtgtggagctgtagtttataatatcaatttaaatagttttaaaaatatttttaatctaaatgataaataaaataacttatctaaatgtcttctaaagacttacagctctagctccatgattttctggagcatctcatgacctgctctaccaacttcaccaaattttctagagccggagctatcccaaacagggcctaaatatagg

SEQ ID NO: 6429 - DNA, 195 bp, Zea mays
aagggtgtgtttggttgcaatgacaggacgagacgggatgggatgattcctcaaataaggttgtttggttcagggtcaaaggctgggacaggactatcctaatattgtccccagttgtccctcaaaattggagggacgagagaggacgacaagggacgtccctgtcttgtctgtcccgcaaccaaacacacccta

SEQ ID NO: 6430 - DNA, 141 bp, Zea mays
ctatatggtctgtttggtttgatgcctaacttgtcacactttgcctaacttttctgtctaaggttaattcttcaattcgaacgactaaccttaggcaaagtgtgacacatttagccacgaaccaaacactgcgactgacat

SEQ ID NO: 6431 - DNA, 101 bp, Zea mays
ttttggcggccaggaaccgccgaaaataggcctcaagctgccgaaaacaatttattttcggcggcaaacgccctatttttggtggctcctggccgtcgaaa

SEQ ID NO: 6432 - DNA, 150 bp, Zea mays
ttgctggtttggtcgcttggaggctaagtctgtcctctctgtcttcggatcctggcttcgcccctgacgatagggtagagacagcctaacacggaaggcataaggttcagatgtaaacagatcttagacgtcagccgacctaaaaatccg

SEQ ID NO: 6433 - DNA, 157 bp, Zea mays
  unsure (92): n = A, C, G or T
gtatataagattaagggcctgtttggtttgtggctaaatgtgccacactttgcctaaggttagtcgttcgaattgaataactaaccttaggnagaaaagttaggcaaagtgtggcaactgagttagtgaaccaaacaggccctaaagtcaccaccca

SEQ ID NO: 6434 - DNA, 148 bp, Zea mays
attgcatgaaggcttgttcgtttgcatcggattgcacccggaatcggtccggctaatcaaagtttatataaattagagaagcaatccggccgggaattgttccgacccaccaatccgacacaaacgaacaaggccagaggcggcccgg

SEQ ID NO: 6435 - DNA, 149 bp, Zea mays
aaaaaaaagtaggctaatccaacagactctgtaggccgaatgacgggtgaaaggctatccaaaaagaaagagcgaaagtggatgaatggagagctactaaattccaagagtcatttacaaagtctattggaagcggttttcttctaata

SEQ ID NO: 6436 - DNA, 141 bp, Zea mays
accgccgacatgaggtgggcgggcgggcggctccaggtccaggtggcgtcgtcggggtgatgcgcgccgacgtggagacgtggccccttccttcttctacgcaaaatcckccacccacccacccacccccatccatccaca

SEQ ID NO: 6437 - DNA, 99 bp, Zea mays
gatatactgccggaattcagctctttgtcgagtgtccgaaagaaaacgttcggtaaatcatttgtcactcggcaaagagccaaatttcggtagtgcaac

SEQ ID NO: 6438 - DNA, 90 bp, Zea mays
cggcgtcttccacctcctgacgtcccggcgctgaaaaattaaagccgacacgaggaaaaaggcaggcaggcaggcacgctcccgcacgaa

SEQ ID NO: 6439 - DNA, 85 bp, Zea mays
ccacaaaaccggaggggattggaggggctggaataaattgaataagaggaaattctagtctctctatttccctccggtttttgga

SEQ ID NO: 6440 - DNA, 149 bp, Zea mays
actgccctctcaggccttgttcgtttgtgccggattggtgggtcggaacgattccgagccggattgcttctataatttatataaactttgattagctgaaacaaatccggttgtaatccgacgtaaacgaacaaaacctcagtcagata

SEQ ID NO: 6441 - DNA, 157 bp, Zea mays
taacaccctcagggctgatttggtgaccatggaattaaatgggatccatgtgtgaggaatcctcttgctatttgctattccattttgagtagcaagtggattcctccccatgaatcccctccaattccttggtcaccaaactagccctcaattccct

SEQ ID NO: 6442 - DNA, 96 bp, Zea mays
agttatgttagctgcatccacacgtacgtctaaaacggacgtacgcggccggccaggctcgcgcgagatcgtacgtgtgggtacagacatccaatc

SEQ ID NO: 6443 - DNA, 105 bp, Zea mays
gtgggcctcggcgtcggcccaaacacggcccgatgcatcgggccgggccggcccggcccaaaataatttcgtgtcgtgccgtgcttgggccgtgctttttttcgt

SEQ ID NO: 6444 - DNA, 141 bp, Zea mays
agctttgggccctgtttggttcgtggctaatcgtgccacactttatctgcggttagtcgtccgaattgaagactaactttagtcataaaaattaagtaaagtatagtaagttagatagcgaatcaaatatgtccctttaat

SEQ ID NO: 6445 - DNA, 103 bp, Zea mays
gtctggcggcgggcccggtggccacagttcccggcagcgcagcgcagcgaagcaagcgctttggagctgataagactgtcttcagcggttcccctaaatttat

SEQ ID NO: 6446 - DNA, 88 bp, Zea mays
gtactgcagggggcagtagggtcactgcacgcgggccctgtcgcacgtgggggccacgcggcagtgccctctcccacgtcagaggatc

SEQ ID NO: 6447 - DNA, 200 bp, Zea mays
agaaaaccctcgaacccctgccccacccatacacagtggaaccgtacccatgtgagaacgatcgcgaccggggctaggccttagacttgtgctttggcgcgggacaaagcacaggtctaaagcctggtcccgatcgtggtcgttctcacatgggctacgatgtcattgtgtatgggtgaggcaggggttcaaggtttttc

SEQ ID NO: 6448 - DNA, 128 bp, Zea mays
gacatcgtagcccatgtgagaacgaccacgatcgggaccaggctttagacctgtgctttgtcccgcgccaaagcacaagtctaaggcctagccccggtcgcgatcgttctcacatgggtacggttcca

SEQ ID NO: 6449 - DNA, 92 bp, Zea mays
gtgatactaatacattacagacggtccgaatagcctgggacatcccaagctgttttctaaccgaaccgcctgtgatgtaaaaagtctaccgc

SEQ ID NO: 6450 - DNA, 177 bp, Zea mays
agactttttacatcacaggcggttcggttagaaaacagcttgggatgtcccaggctattcggaccgtctgtaatgtattagtatcacaagcggtttttgtttcggaccgcttgtggtgctctattcgtttcacaaacggaccgtaatgaaaaaactgcctgtgattgtgatttgatt

SEQ ID NO: 6451 - DNA, 183 bp, Zea mays
ggccacgcaagcctccgcggccacgcgccacctggtggccgccgccgcttccgcctgggcgccgtcggcgaagccgcggcagctaagctcacagctcgcgctgccgccgtcgtcctcccgcgcgccggccccgctccgcgcgaccgccggggaggcggtgaccgaggaggcgcccaaggggtt

SEQ ID NO: 6452 - DNA, 76 bp, Zea mays
tctagatgcaatgcacggacactgacctatcttatataatacactaggtgagtgcccgtgcgtcacaggtccgagt

SEQ ID NO: 6453 - DNA, 152 bp, Zea mays
gggccgataggctaacaggctggcccgacacagtcagcaggccggcatgacgtgtctgggccatacttcagcaggccgacatgacgtgcctggaccatagttgtggcccgcatgtatctggcccatgtcgggctgccgtttggctatctata

SEQ ID NO: 6454 - DNA, 151 bp, Zea mays
cagccccacgggcctacgggccgagcctacacagtccggcgtgtctcaccagaggcccacacacggcccttcgggccgtttttcgggccgggtcagcccgaaaagccctgatccaaaagagtgttgggtcagcccgaagctcggtaacaaa

SEQ ID NO: 6455 - DNA, 137 bp, Zea mays
attcagttgagcccgtgcgttgcgacgacacacaatcatatttgatgagcaactatgacaatccatttaaatgaaaaataatatatagtcaagtaattagcatttctttaatcttgaacgcatgagttcgcttttac

SEQ ID NO: 6456 - DNA, 159 bp, Zea mays
  unsure (152)..(153)..(154)..(155)..(156)..(157)..(158)..(159): n = A, C, G or T
agcaaaagcaaggctggctggctgcgtggccggtattcatataattagaattgaactgcaagcgtttggtcatgatcgtatgcttttgcgtggcatgcatgcatatatgcacgactatagcaagctcatacagtcgccagcagccagccatnnnnnnnn

SEQ ID NO: 6457 - DNA, 102 bp, Zea mays
gtgttgaaaaaaaaagcactcggcaaagaagctctttgtcgagtgttatatttttgacactcggcaaagagcttctttgccgagtgttttcttttaccgagg

SEQ ID NO: 6458 - DNA, 150 bp, Zea mays
tttactatttagggctgatttggtgacaagagaattagatgagatctatagggagaaatcccttttctattcaattttggatagaatgagaattcctccacatgtattccctctatttctctggtcaccaaatcaacccttaaacttgaa

SEQ ID NO: 6459 - DNA, 152 bp, Zea mays
gggggcggacgcagacaacgacgacggcgtctacggcgtgtccagggcgtcgtcggtggcgtcctcggcgctgctgagctccgcgtcgtcgtggccgctggactcatcggacacttcgtcgtcgtcgtcgtcgttgtcgcgctcctcgtccg

SEQ ID NO: 6460 - DNA, 141 bp, Zea mays
ggtccgtgccaacccagcctgagcacgactaggtcccatacggattagctagcaggtcgtgtcgtgtcggcccacgggctccaagtgagggctaggaacagtccactaggttaataatcgtgccgggctggcccacggcac

SEQ ID NO: 6461 - DNA, 234 bp, Zea mays
gctttatgcattgcataagctgataagcatcttaccaccgcaactatcacccataggagtagccacagctagggctgcctagagttcttttcaacatgtccaatagttgacagattgactcccattaaaatgtaataggcctaaggctacttactgtttcactcctgctaacatatactgtgtgtaaaacaacttaatataagatccgatcagatatgtgtcgatgctcatccc

SEQ ID NO: 6462 - DNA, 108 bp, Zea mays
agccattcaagactttggctagcatctctggtttgcctgtccaaccatatgacaaaagctttcaacagcacaggcaaaaagacagtggtagtatagtccaacaaatgg

SEQ ID NO: 6463 - DNA, 112 bp, Zea mays
actcttaggtctagttttgcaactcttttttgtcaaggaattttcattttatcaagagaaattagttcatttatacttagaaaaatggagttgacaatctagcctttagccg

SEQ ID NO: 6464 - DNA, 124 bp, Zea mays
tagtttgggtactctagtattgaagtggtttggagggattggagagtgtataaatccccaatagatcaaaaactctcataatacatcacaatccactccaatccctttcattactagattatct

SEQ ID NO: 6465 - DNA, 231 bp, Zea mays
ccctccgtcccaaattataattttgttgacttttttgtgccaagtttgactggctcgtcttgttcattttttttgcgaaaaaataaaaaatccaaatgcatacttaaagtatataatatgctagaagatatcactgtaaaaattaacaataattatggaattttttgaataagacgagccggtcaaacttagggtaaaaaggtcaaactaattataaattggaacggaagg

SEQ ID NO: 6466 - DNA, 65 bp, Zea mays
cccttggtcctgcgtgagagccgcaagtaccactgtggacttcgcgcaggatttagatgccgttc

SEQ ID NO: 6467 - DNA, 95 bp, Zea mays
atacattagcggatctggtttcgactaatttcggtcgaaccacgaactgcgacttatcagtgccgaaatcagtttaatccggtctgttgtttcac

SEQ ID NO: 6468 - DNA, 93 bp, Zea mays
accggaacaagtcaggattcattccagctcattaaaatctatataaattagagaagtaatccggttaggaattaatccggggctccaattcca

SEQ ID NO: 6469 - DNA, 130 bp, Zea mays
taaaaccgcctgtgatgtgtgactatcacaggcggttcttttaaaccggaccgcctgtgatgtgtgactatcacaggcggttcttttaaactggaccacctgtgatgtgtgactatcacaagcggttttt

SEQ ID NO: 6470 - DNA, 135 bp, Zea mays
aaattagagaagtaattttggtaggaactattccggtcttccattccgtgcgaaccgaacgggcccttaggccttgttcgtttgtgccggattggtgggtcggaacgattcctaaccggattgcttctctaattt

SEQ ID NO: 6471 - DNA, 106 bp, Zea mays
tttctctagggttgtcggctggttgcgcccgtgccatcctgtctctggtggccttcgtctctgggcagtctcttgtagggtgcacgcagtcttcgccgtggaacaa

SEQ ID NO: 6472 - DNA, 100 bp, Zea mays
tgagccactttttttggctcatgccctctagttcattttggaaaaacacttcactggtgaagccatttgaaaaagaggtgtttggcacaacttttgcatg

SEQ ID NO: 6473 - DNA, 115 bp, Zea mays
ctttagcaaccactccatattttgatctatcttttttataaagtttgagttcatgtgactttatttagaaacttgagctcacaaacttccctcttattgggtctctgtatggtgg

SEQ ID NO: 6474 - DNA, 110 bp, Zea mays
taactggggggtccagcactgacttcgacaccaagcggcagaagcgggaccattaccgcagcatcaaccatgtcgccgtcacgggtccagtcgtgcagacaaagtggtcc

SEQ ID NO: 6475 - DNA, 70 bp, Zea mays
tagggccctggggcctgcgtgggagccgcaggtccccctgtggacttcgcgcaggatttgaatgccttcg

SEQ ID NO: 6476 - DNA, 71 bp, Zea mays
gagggccctgggccctgagtgagagcctctatgttgcgtagtggacttcgcgcaggatctggatgccttcg

SEQ ID NO: 6477 - DNA, 109 bp, Zea mays
tggtggtgtcctcctctatatatagtgcagagtttgggccccgaaggcccatgtggctcatctagccgaaacactaactttgcactatatatagaggaggactctacca

SEQ ID NO: 6478 - DNA, 171 bp, Zea mays
gacaatgatatagccaatgatgacttgccgataaaccctatataacatttattataatgttctagatctggacttcaatatgatatacaaccatatatatatgccatggatttacattggaatgttaaaagaaaaataggtcggcaagtcatccttggctgaaacattgcc

SEQ ID NO: 6479 - DNA, 114 bp, Zea mays
tttgctcggcgctataggctatggcgtcgaagtacgtgctgcgctggcacaaacggacgtcctggtgccgatgtggcaccaagctcggcgccatagatcttggcgccaaattcg

SEQ ID NO: 6480 - DNA, 192 bp, Zea mays
gggtgtttgaatacattagaactaatagttagtgactaaaattagttaaagcattcaaacaccctagctaatagtttatctattagctatttttggtaaattaattaatagttaggtaactatttattagctaccaattctactaacaacttttagtcaactaactactagttctagtgcattcaaacaccc

SEQ ID NO: 6481 - DNA, 122 bp, Zea mays
ctttagcaatcactccatattttgatctatattttgtataagtttgagttcatgtgacttattttataaacttgagctcacaagctttctcttatttggtctctgtatggtggaattatatc

SEQ ID NO: 6482 - DNA, 104 bp, Zea mays
acaagcaaggggagatattgacgcggctcaatccaagaacatggctgccgcgccagtcatccacgccttcggattgaggcacgccaatacctcccggcattgtc

SEQ ID NO: 6483 - DNA, 104 bp, Zea mays
gacaatgccgggaggtattggcgtgcctcaatccgaaggcgtggatgactggcgcggcagccatgttcttggattgagccgcgtcaatatctccccttgcttgt

SEQ ID NO: 6484 - DNA, 227 bp, Zea mays
cactttgcctaacttttgtgcctaaggttagttcttcaattcgaacgactaaccttaggcaaagtgtggcatatttaggcacgaaccaaacacccccttagtctttcacataggtgctaaaagagactaaggggctgtttggttcgtgcctaaatatgccacactttgcctaaggttagtcgttcgaattgaagaactaaccttaggcacaaaagttaggcaaagtg

SEQ ID NO: 6485 - DNA, 129 bp, Zea mays
catatttttcgtttatgtcgctgatttgtccgtcttaatttatttctcatccagtttttttgtgactgatttgtttattcgtctagatttttttatccggcgagcacatcagctgtatatgcagtaaat

SEQ ID NO: 6486 - DNA, 142 bp, Zea mays
gccagtaaaacgtactgtactctaaatatagcggatgtagacgttcggtacgcgtccaacaacatccgctaaaccctccggtaaaaaataatacagggcctccctcatccgctacatttggagggtagacgatggctcgcta

SEQ ID NO: 6487 - DNA, 124 bp, Zea mays
aagtcccgctgtggacttcgcgcaggattggacgccttcagtctcggtgacacatttaagcaatggctgactgaccccttcttgtaaagctgccttcaatcagtgcgaagtcccggcttcgatg

SEQ ID NO: 6488 - DNA, 164 bp, Zea mays
ggttctctacatcttcttgcgcctctactgctgacgggagggaaggaagcagatctggtgattcgtggtaacgtagttctcaacacgatcgacgcatggagaccgtacaagcttccctgacgcctctgaaaggcatgatgaaggaacaaggagaaccctacaga

SEQ ID NO: 6489 - DNA, 148 bp, Zea mays
  unsure (65): n = A, C, G or T
  unsure (120): n = A, C, G or T
atccattgctaagatcacatcaatcccttgggatggcaagacggctaagtctgccaagaacactnccccacttaaaagaatcctcacttgggagcatttgagttggcatagaaggtctgnccctggggttcgggtgaccaatggaatt

SEQ ID NO: 6490 - DNA, 121 bp, Zea mays
cggtgcgcctgtagttggtctttgcgcggacaggttggtgtagggtttatctcgggtagtcttttgaggaagacttcgattctgcgcacttgttgtgcttagtccggctgcacccttacgc

SEQ ID NO: 6491 - DNA, 126 bp, Zea mays
aatcgctacaagctaagcctgcgcgtggtgcattagctgggagcctctcaccattaccgagcacagaagaagtgcaccactgcactgagaaacatttagcgccgctgttggcttgcgtcaagcgat

SEQ ID NO: 6492 - DNA, 70 bp, Zea mays
gttgattcacacaattggtcatcgcgcttggttgaaaaggccgtggagcgaagctaccgtgtgccggatt

SEQ ID NO: 6493 - DNA, 73 bp, Zea mays
tgtgtcgcttcggcggatcaagggttgggaagacactcgcattctcttgcccttctcggactgacgcctggtg

SEQ ID NO: 6494 - DNA, 96 bp, Zea mays
caagaagctgtagaggatccgtctctcttcccataagcacgacagaagaaacacacgagacactggatatagggttgggcctctgacctctttttc

SEQ ID NO: 6495 - DNA, 69 bp, Zea mays
gtcaggcggcggaaatagcattatgtccgacggccgccctcctgacataagctatctccaacggccgcc

SEQ ID NO: 6496 - DNA, 76 bp, Zea mays
agagagacagggcgggggtgagggcgggcttcaccagattgaggtgtggacgcctataccatagccatatagaata

SEQ ID NO: 6497 - DNA, 123 bp, Zea mays
agacactggatatagggttgggcctctggcctctttctgatctctgtaatatgatgaggtgtacaagttccttatatagagatgtgagacccctcagaggcaaaaccggtatttgcccacata

SEQ ID NO: 6498 - DNA, 74 bp, Zea mays
cgtcctctaaacggtcctctaaatttagaggacgctgctggattctctaaatttagaggaccgtttagaagacg

SEQ ID NO: 6499 - DNA, 167 bp, Zea mays
acggagtgtgtcccttggcgcatggctgggcgttcggcgaagtatgcccccggcccccgccagatgccctccttgggcgagcagctagtgcgaagtcctgccttcgtgttggatctgcgtggccgggatcctgccgcattcgtgcgtgaggtggaagacgaggctgt

SEQ ID NO: 6500 - DNA, 163 bp, Zea mays
gagtttctctaaacggttctctatctatttgaatactttaaacaaccggtttagtaaaactaaaatatgtaaatatacatttaagagtatgacaaatacatatgtacaaaaaaaataaaaaataaaaatgtctttaatatagtgtcggggaccataattaggg

SEQ ID NO: 6501 - DNA, 166 bp, Zea mays
agctgaatcagaatccttgccgtgttcgcggatagcgcgtcagatttagaatggtaagccgattcaaaatttccgttagcttgattattaaagtagttcgatgaatgtgatatgcttattttcatgattttgaagcagttgcgtcgcggtaggattaaatatatgt

SEQ ID NO: 6502 - DNA, 177 bp, Zea mays
ttagcccctatcacatcgaatgtttgaacttccgttccgggtattaaatatagtcggattataaaactaatttgtcagccgaagattaaaagacgagacgaatctagtccagttggttgggtctatatttcatactcctatttaaaagtcaaacgcttgatgtgacccgggctaaac

SEQ ID NO: 6503 - DNA, 82 bp, Zea mays
cgcgctcctctctgggttttgcggcggccgccgcgccctcctactcatcggggcatgtcgctcgcccagatgtccgggtgtg

SEQ ID NO: 6504 - DNA, 77 bp, Zea mays
gggtccccgggttttgcggcggccgccgcgccctcctactcatcggggcatgtcgctcgcccagatcgccgggggtg

SEQ ID NO: 6505 - DNA, 75 bp, Zea mays
gctcccgggttttgcggcggccgccgcgccctcctactcatcggggcatgtcgctcgcccagattgccgggtgtg

SEQ ID NO: 6506 - DNA, 115 bp, Zea mays
gatgggccagcacgagcccggcacgaaataaatggcacgtagcccggcccagcacgaaacagaaaaaaccgggccagcacggcacgttatacgggccgggccgtgcttcggctgg

SEQ ID NO: 6507 - DNA, 92 bp, Zea mays
aagtttggacccgatgctcggcgccataggctgtggcgccgaggtaacacagctcggcgccatagcctatggcgccgaggtctgacgtggca

SEQ ID NO: 6508 - DNA, 226 bp, Zea mays
gcagtgaggcgcgggcgccggaggctcgactgcgcgactacggcaagtggttctggcggcgagcgtgcataacagagaagaaatcatgctgaagggagcatgaggtaggaggcaagcacagctcggacttttatagcctaggcgggagagggaattgtggcagaaccacccgaattattccagctataagtgcctaagtcacgcctcaggggccgtcaacacactt

SEQ ID NO: 6509 - DNA, 232 bp, Zea mays
atggtacatgtaggtctacatagtgtaggaacataccacaaaaagtttggtagggataatataaaaaataaaaaagtaattggccggagtgtccacaaatgacactcgagcaaaccatcctttgccgagtgtcatttgtggacactcggcaaattacttttttatttttgatattatccctaccaaacttatagtggtatgttcctacactatgtagacctacaagaaaaca

SEQ ID NO: 6510 - DNA, 84 bp, Zea mays
ttaggtattagtactatggcattcaacctaaatggtttcaatttcaaccaatctgtagttgatagccaaggtcgcgttattaat

SEQ ID NO: 6511 - DNA, 205 bp, Zea mays
aaaatttaaatatattttgccgagtgccccagcttggacactcggcaaagaaagctttgtcgagtgcttgtcgtgcggctctcggcaaagtttttttaaaaaccctaagtctagtctttgccgagtgccaacagacaggcactcggcaaagaagcctttgccgagagccagatcaaaggcactcggcaaagtatattttttaatt

SEQ ID NO: 6512 - DNA, 172 bp, Zea mays
tgcccatgacgtaagccagcgggcggagtctgacgtaaggcctctaggccgcgcggtctctacatttattgcagagagtacatgccgcctgtccaccctactgataggcgaaagacaaacataagcatttaatgtgtcctgtcgactccgctggcaggcggcgccagggcca

SEQ ID NO: 6513 - DNA, 71 bp, Zea mays
gcacagagcactcggcaaagaacctaacatggggaccctacctggcgggctctttgccgagtgctactagg

SEQ ID NO: 6514 - DNA, 76 bp, Zea mays
tgtcgatgttccaggagtgctccaggtcctcgccatttggcgttgtgagcctgtaagcgctgggggaagcttttga

SEQ ID NO: 6515 - DNA, 71 bp, Zea mays
cttgccacatcggctgccacgtaggaaaagttggcgccaatggtactggcgtcgatgtgtgttacctcggc

SEQ ID NO: 6516 - DNA, 159 bp, Zea mays
gtgcctgtcggttggcactcggcaaagtctgtagaacacatctttgccgagtgctctacagctagcactcggcaaaagacacctttgccgagtgctagctgtagagcactcggcaaagatgtgttctacagtctttgccgagtgccaaccgacaggcac

SEQ ID NO: 6517 - DNA, 157 bp, Zea mays
tgcctgtcggttggcactcggcaaagactgtagaacacatctttgccgagtgctctacagctagcactcggcaaaggtgtcttttgccgagtgctagctgtagagcactcggcaaagatgtgttctacagactttgccgagtgccaaccgacaggca

SEQ ID NO: 6518 - DNA, 92 bp, Zea mays
cggattggtgggtcggaacgtttcctagccggattgcttctttaatttatataaactttgattagctggaacgattccgagtgcaatccgac

SEQ ID NO: 6519 - DNA, 83 bp, Zea mays
caccgggcaccgacgacgaagggcggttgcgaagcgtaggattagtgcggaggaaggggctcgtcttcgcgttagtagggtgg

SEQ ID NO: 6520 - DNA, 151 bp, Zea mays
aaccagcccttagggctagtttgggagccacaaaatgagagggaattagagtgactaaaatccctttttattcaaaattgattgagaaggagattctagccacttcaatcctctccggttttatgttcccaaactagtcctcgacactctt

SEQ ID NO: 6521 - DNA, 110 bp, Zea mays
tgagaatagccggggtgggccggtgttgaggcccgggcggggtgaaacgaatgctgttttgtcgtgggccgggattttttccagaccgggctgatccacggggaattggg

SEQ ID NO: 6522 - DNA, 81 bp, Zea mays
aattaaaggcaggtcggccggcacaaaagctatcccgacgatggcgagtggtcattgttgtcggtcctcctctgcgtcacc

SEQ ID NO: 6523 - DNA, 86 bp, Zea mays
agcggtatgtgggaccacttcgtctgcacgactgggccagtgacggcgacgtggttgatgctgcggtagtggtcccgcttctgccg

SEQ ID NO: 6524 - DNA, 79 bp, Zea mays
tttggtctggtgggcgcagtcttcgccgtggaaaaggcaatagaaccggcgcggcggctgctgcgcccgccctcgaccc

SEQ ID NO: 6525 - DNA, 90 bp, Zea mays
gttgctggactctttgagtttgttttggttgcaggtgtcgtgcgtggagcgacatggggaggccgaaacgtgctcgtggaggccgagact

SEQ ID NO: 6526 - DNA, 95 bp, Zea mays
ttccggttcagcccttgtgtcgagcacttggtgaacatcacgaagctagccgcgtgatatttaccaagtgctcggcgaaaggccagaacaagaat

SEQ ID NO: 6527 - DNA, 134 bp, Zea mays
aactttagatgttgttgttgcttcttcatattatatgttcaaattcaaaatagaaacgaatacttttctcaatcacttggacaagtctcaaaaggttttggagaatgcaaggggtcacgaccacaactctaatg

SEQ ID NO: 6528 - DNA, 180 bp, Zea mays
tagagtatccataccaccaaggtgcatcttattttttggaagcctatctcaaaagaacctccaagttaagtgtgtttggcttgaaaaaatttgggacgggtgaccaaccgggaagttttcttgagtgcgcatgaggacaaagtgtgcacaaaagacccatgttggtttgtgggacaatat

SEQ ID NO: 6529 - DNA, 96 bp, Zea mays
gcggagtccttcaccatagggtcttcgactttataaatctcgcgcccaaaatcttcatcagatcggtcgaagacctcatagtgactgcacccctcg

SEQ ID NO: 6530 - DNA, 220 bp, Zea mays
ttcttttatagacattttggacctggtgcgtctgaaccggttggcaacatcgggtcagggatttcgctcagctattggaagcctagggctctaaatacataaactatatatatatatagtttgtatattatgagtcttcggttttcaaaagctagagaaagctctggcctaatgctgcaatccggttaagccgaaccaggtcacggtgtctataaaaaga

SEQ ID NO: 6531 - DNA, 76 bp, Zea mays
gcgatggccctcggtgtcgttagttatttgtagaccctctggactgcggacggctggcgtgccgatgacgtggtag

SEQ ID NO: 6532 - DNA, 112 bp, Zea mays
caaagcatactttgccgagtgccgccgatctggcactcggcaaagtttattttaaaaattaaaaaaaactttgccgagtgccagatcacgggcactcggcaaagaaggcgaa

SEQ ID NO: 6533 - DNA, 76 bp, Zea mays
atcacaattaagggagaccgaacgggttcaaggcattgggcagaatgaacgctttttcctctcctttatccttgga

SEQ ID NO: 6534 - DNA, 148 bp, Zea mays
ctatcaccttaggccttgttcgtttctgtcagattggtgggtcggaactatttctaaccgaattgcttctctaatttatataaactttgattaggtaaaacgattctgggtacaatccgacacaaacaaacaaggccttaatcctttg

SEQ ID NO: 6535 - DNA, 177 bp, Zea mays
cctcggatctagtccgacaaggccactaacaggatcaagtaccacgtactcactcgaaggtgagaaacaaagcaaatacaataaagcataaaaccataatttaaaggaattcttaaagttattacaacatcatcggagtttatcaaaagtagtgatcattgttcggaatgcagcgga

SEQ ID NO: 6536 - DNA, 176 bp, Zea mays
agtaatcggctgattggatgcatgtatggggacgctcaggctcgggtggccctggctgacctaatacgacatttttctgcgtacgagtggatgcaaatggctataaaattgcttattttgcatccacttatgcagcctacgactcccttgtgcaggcaaccaaataggagctcaga

SEQ ID NO: 6537 - DNA, 171 bp, Zea mays
ttacaagagacccgtgcgttgcgacgggaataaaccataaacaataagaaccaattatatgaatttatgagatattgaggtccacaatgtattgttcattttcatgtaataattatgcacttacattttatcaaatattatatgccgtcgcaatgcacgggtatttaacta

SEQ ID NO: 6538 - DNA, 90 bp, Zea mays
agtgccagtcgatactcggcaaagaaaagtgtccgtcacggcaccgggtgacggagacgacgtctttgccgagtgtctcctaatccattc

SEQ ID NO: 6539 - DNA, 95 bp, Zea mays
cggaatccttcaccatagggtctttgaccttaaaaatttcgcgcccaaagttttcatcggaccggtcgaagacctcatagtgtttgcacccctcg

SEQ ID NO: 6540 - DNA, 90 bp, Zea mays
tcctattacaaggccgaagcctatcagacagcccattcggaacccatgactcgaacaattggtttgcgtagacgccggcccatcttcctt

SEQ ID NO: 6541 - DNA, 172 bp, Zea mays
tgtccaaaataaaacactcggcaaagaaactctttgctgagtgtcaaaaataaaacactcggcaaagactctttgccgagtgtcaaaataaaacactctgcaaagactctttgccaagtgtcaaaaaaacactcggcatatagtttctttgtcgagtgtttttctaccgatg

SEQ ID NO: 6542 - DNA, 90 bp, Zea mays
tgtcaaaaataaaacactcggcaaagactctttgccgagtgtcaaaataaaacactctgcaaagactctttgccaagtgtcaaaaaaaca

SEQ ID NO: 6543 - DNA, 80 bp, Zea mays
gctgtctctgagtctaggcgttgagctttgcatatgaggtcttctagcattggtttgacttcgagactgccgttgtttcc

SEQ ID NO: 6544 - DNA, 102 bp, Zea mays
gtcggatataacgacagccgtcggacataatatcctacgttcgacacctggcagaaggaccgttggacataatgttatattcgacggctgtcagataagttg

SEQ ID NO: 6545 - DNA, 84 bp, Zea mays
agtgtcagaaccatagcactcggcaaagaaccaagaactggacaccggtataggttctttgccgagtgtagtggccctggcact

SEQ ID NO: 6546 - DNA, 140 bp, Zea mays
tagctaaaaagactagccaaatttactgatttagctactctctaaaatagattttagagaaaaagtgtaggctaatccaacagactcggtaaacctacgaactgaatagagagtgaagcaggctatccaaaattagagag

SEQ ID NO: 6547 - DNA, 225 bp, Zea mays
ggcgacgtaaggaagtgagagacgccgtgcgggggcctcgggaagagttatcttttctgcttaacggcccgccaaccctggaatcggttcagccggaggtagggtccagcggccggaagagcaccgcacatcgcgcggtgtccggtgcgcccccggcggcccttgaaaatccggaggaccgaattccgtccacgcccggtcgtactcataaccgcatcaggtctc

SEQ ID NO: 6548 - DNA, 109 bp, Zea mays
ctaccggaatcgacctctttgccgagtgcctgaagcactcgacaaaacttgaaaaacactcggcacatgctttgtcgagtgtcgtactcggcaaagagggctcgacgaa

SEQ ID NO: 6549 - DNA, 126 bp, Zea mays
cgtggcacatacctcgacgccatagatcttggtgccgccggtcaacgacccttacctcggcgccaagatctatggcgccgaccttacctcggcgtcaagatctatggcgccgaggtatctgcatat

SEQ ID NO: 6550 - DNA, 93 bp, Zea mays
aagctcgacgtcaagatctgtggcgccgagctagattgccacgtgccctgccacgtcggtaagctcggtgtcaagatccgtgacgtggagcta

SEQ ID NO: 6551 - DNA, 124 bp, Zea mays
gccaaagaaacagtctttgccgagtgccagatcgcgggcactcggcaaagatttttttaaaattaaaaaatatactttgcagaagtgccttggatctggcactcgacaaaggcttttttgccga

SEQ ID NO: 6552 - DNA, 74 bp, Zea mays
acgaaaggctgctcgtccgagcaggagaggaaggaacaactggagctcttgctgccgactgagtatatggagag

SEQ ID NO: 6553 - DNA, 72 bp, Zea mays
gatgcgattgtggagaccgtgctgtcatcgatgaagactatgagaagcagttctgtcgtccgaacattgatt

SEQ ID NO: 6554 - DNA, 202 bp, Zea mays
atcactcggcgtagtctttgtcgagtgtgacactcgacaaagaagtctcggtgaactgtacatcgacaacgatttctttgtcgagtactttttgtcggacactcggtaaagaaaagtcgtcgtcacggcgccaggtggcggtgacgaagactttgccgagtgtctactgtactggcactcgacaaagaagcaccctgtgggc

SEQ ID NO: 6555 - DNA, 137 bp, Zea mays
atgcaatgcaatgacagttagtcggtcacgtctgggcatctagctgcactgtagagccacgatgtctcaacggaggtgccggtgtctccatggcatgtggggctgcaagatgtgaccacgacttggttgctggcgca

SEQ ID NO: 6556 - DNA, 107 bp, Zea mays
aaaatggtatatggacccttgctggagttggtcttaaagggttttctatggggtgtttgatttgaggcaggggtagacccagcgggtggtccatttaggccacgaca

SEQ ID NO: 6557 - DNA, 120 bp, Zea mays
gacgcactcatctcaggactgcttgttatcttaatcttaaaaaaaataaatgatttgctttgctaggggaccggttctcgtggttcaaggacgaggagttcgcgaggcagacgatcgcgg

SEQ ID NO: 6558 - DNA, 109 bp, Zea mays
cttcctgcctgctgctggaattgctgctgacccgccatttccctaaggaagcgggtattgtctgcggtggcattcaccaaggcggcaatcgcctcggctaacgtgggag

SEQ ID NO: 6559 - DNA, 147 bp, Zea mays
gagtgcttcaggcactcggcaaacactttgcccagtgtgacactcagaaaagagagctcggcgaacagtacatcggcaacagcttctttgccgagtactttttatcgggcactcgacaaagactttgccgagtgccagttggtactc

SEQ ID NO: 6560 - DNA, 145 bp, Zea mays
cggcctggcccaagcccgaaaaggcccgtcttgtttgaatttcgggccggtccggcccgtttgaatttcgggtcgtgccggaccggcccacggcctggcacgcaattgattaaacgtgacgggctcatttcgggcgacccgaaat

SEQ ID NO: 6561 - DNA, 191 bp, Zea mays
ctcctaggaagacccggcctcgaaaagtttaatttggagctccctgtttgatccgtcatttcaagctctctgtttggtcacgtagggtgagctgcctccattggtgtataagtgaagtttaggacgtgtttggtagctgacctaagccaccgccaccggccacacttttcccgccgcagttatggcggccg

SEQ ID NO: 6562 - DNA, 136 bp, Zea mays
acacttagcctaatgttagtcgttcgaattgaaaactaaccttagacagaaaagttaggcaaagtatgacaagttaggcatcgaaccaaacaggccctagcttttcaattcgaacgactaaccttagttaaagtgt

SEQ ID NO: 6563 - DNA, 71 bp, Zea mays
tgcttcctgccgacctgccctgccccacgctcgaccagcgaggtgcgcgcagtggagatcgatcggaggcc

SEQ ID NO: 6564 - DNA, 173 bp, Zea mays
ctagaaaagcgtaattattgcgcgtggtcgtatattaataactagtgtttccgtacaaaattgtacaatgccctcgccgctaggtgtttaaattcgccatcgcgtagcactatttagggtgtgtgatattctttgtcgatatgcattcatgtgcattattgcattttcattta

SEQ ID NO: 6565 - DNA, 93 bp, Zea mays
tagttcaccgagctttctttgcctaatgtcacactcggcaaatctttcgttgagtgttttacaggcactcggcaaagaagttatttccggtag

SEQ ID NO: 6566 - DNA, 96 bp, Zea mays
gggccgctggatctccggcggacggccaggattgggtccgggcgagttgaatcagggccgcccgatctgggttgaacggcggagatcggatgggcg

SEQ ID NO: 6567 - DNA, 133 bp, Zea mays
gtctgggcgctgaacacgactgagtgcagggcgactgggttcacccctttccgccttctatatggatcagaggccatgaccccacaagaaacaaagcatgggtccccgcgaacagttgcgtcagctgtccccg

SEQ ID NO: 6568 - DNA, 214 bp, Zea mays
catagtcttttaggatgtgtttggttggatgtacaaggagagatgaaaggggacggccaaagtttctatagtatttggatgagaatcacgtgagagcgagataaaacactggagtaatttttggtggcagcgtgatcccaaaaaaccgaaggaacggtgtcgtcccgtctcatcctactttaacctcaaatcaaacacatttagagttgctctg

SEQ ID NO: 6569 - DNA, 90 bp, Zea mays
gggtgcagccactatcaggtcttcgaccgatctgatgaggatttcgagcgcgacatttacaaggtcgaggaccctgtggtgaagaaatcc

SEQ ID NO: 6570 - DNA, 165 bp, Zea mays
gatgagcatagtgtacgccgcagcacgggcgtactgtctgccaacggaatggacaggcatgccgcctgcaagatggccctggtcgctgtttgtcaacggagtggatggggcacattaaatgctgaggcggcacatcacccgtcagcggggtggacagggctcatt

SEQ ID NO: 6571 - DNA, 83 bp, Zea mays
agtgcaatgaccatagcactcggcaaaaaagtacacctggaaaccggtaaaacttctttaccgagtgttatggtcgtggcact

SEQ ID NO: 6572 - DNA, 83 bp, Zea mays
tgaccctttgctcggcgctatagtctatggcgccgaggtaacacagcttggcgccatagcctatgacgctgaggtacctggtg

SEQ ID NO: 6573 - DNA, 120 bp, Zea mays
gtttatttgctttctttgccgagtgcccgtgatctggcactcggcaaagattttttaaaaattttaaaatattctttgtcgagtgccagatcgctgggcactcggcaaagtgtcctttgt

SEQ ID NO: 6574 - DNA, 220 bp, Zea mays
tgagtgtcacctagtacactcggcaaaggctccgtcgccgttacctggcaccgtgacggcgacttttctttactgagtatcgagtgcccgataaaaagtactcgacaaagaagtcattgccgatgtacagttcgtcgagctttctttggcgagtgtcacactcggcaaagcattcgccgagtgttttacaggctttgccgagtgtccagctgattccagt

SEQ ID NO: 6575 - DNA, 114 bp, Zea mays
gtgaaatcgtgagggtcggctctgataccatctataacaccccattcactcctggataagcggtacttactcctagtagccctctaggatcaaagaccatccccacataccatc

SEQ ID NO: 6576 - DNA, 145 bp, Zea mays
ctggtgatgatggtgttaagtgccggtgggctcggccttcttataagtctaagtaactgttggggtcttgttctcaaatgctatgaattaagaacaggcaacataaaatgttaaatatcatgccttcgtcgcgaaacattatctc

SEQ ID NO: 6577 - DNA, 93 bp, Zea mays
ctactgacaaagccgtcggagataaccttatgtccaacggctagttaaacggccgtcggacataagcttatgtccgacggctagttacgaggc

SEQ ID NO: 6578 - DNA, 253 bp, Zea mays
attacatattgattccgtagcaacgcacgggcatacacctagtttactattatgaccgatagtattatatatacctacatgtatatatattgtcacgaattgttgtatgatttttgaattagattagacttaaaagtacctagattcttattactttgttgttgtcacgtagtccgtaatgtggttattcattcttgttattataacattactaggtgagtgcccgtgcgttgcaacgggaccatataatact

SEQ ID NO: 6579 - DNA, 151 bp, Zea mays
actaccacttaggccttgtttgtttgtgttggattgtacccggaatcgttttagctaatcaaaatttatataaattagagaaacaatccggttatgaatcgtttcgacccatcgatccgacacaaacgaacaagaccttatatagttgcat

SEQ ID NO: 6580 - DNA, 108 bp, Zea mays
tcggacggatcctgttaagttatctggtgcacatgcggacccaataacaagagtctggagacaagggcagaagcatgtgggcccaataacttgggaggtatatcccca

SEQ ID NO: 6581 - DNA, 103 bp, Zea mays
ttcaccttggatggatcggctggtcctggcattcttttgacactggacactcaaggaggtgcttgcctactaagaactagtcccactgtctattactcgggtg

SEQ ID NO: 6582 - DNA, 102 bp, Zea mays
gtggaacgtacctcggcgccatagatcttggcaccgaggtacacgcccggtcaacgacgcctacctcggcgccaagatctacggcgccaaggtacgtgccta

SEQ ID NO: 6583 - DNA, 115 bp, Zea mays
agggattcctagtggttcgggccgccggagcgtaataccctactccactgtgtagaatggattgttgtagactgtttgagctgtgtgtaagcctgaatgacttgtgtctgagtcc

SEQ ID NO: 6584 - DNA, 148 bp, Zea mays
gcaccagagctttcttcgacgagtgcctcagacctaggcactcgacaaaggctccatcacccgttgtcgtcatggtgactttactttgccgagcgcccgatggaaagtaataaccaaagaggccgttgtcgatgatcggttcacggag

SEQ ID NO: 6585 - DNA, 85 bp, Zea mays
tccccgtcgagttcgtggggacgggacgggaaccatcccccgtccccgttccccgtgtacccgccccacgaatcttttttattca

SEQ ID NO: 6586 - DNA, 119 bp, Zea mays
ctacatgatgtaaagctttcgtgccgtataatcaataaatttcgtgtcatattcatagactgattaatatatgtatactagtcgtttgcccgtgcgttgcgacggcttacaacaatacc

SEQ ID NO: 6587 - DNA, 148 bp, Zea mays
ccctcgctgaactccctcgggatgactgcacggtcgcgccatgctttggtctgggcatggtatttgcttagggcctgtagggtgaagacccggtctccttcaatgagatcttttgaagctggctcgtccacgtcggggacggctgacg

SEQ ID NO: 6588 - DNA, 167 bp, Zea mays
tgcccgtgacgtaagccagcgggcggagcctaacgtaaggcatgtgggccgcgcggtctacatttattacggagaggacgcgccgcctgtccaccctgctgacaggcgatgtgccctcagcatttaatgcgtcctgtccactccgctggcaggcgacgccagggcca

SEQ ID NO: 6589 - DNA, 92 bp, Zea mays
tgggatgggtgaccaccgggaagttttctcaggtgcacatgagtgaggacaaactgtgcataaaagactcgtgttggtctgtggggacgata

SEQ ID NO: 6590 - DNA, 74 bp, Zea mays
gcatggcagtggcacgagcgctttgggcaccttaactttgaggccctgaagcggctcagtgccaaggagatggt

SEQ ID NO: 6591 - DNA, 148 bp, Zea mays
taagaacgtgggtaccgacgttcttaattgagttaagttcatgggttaatttaagaacgtgagtaccgacgttcttagtttaaattcatgcgccctagctaaaaccgtcgaacttatcgtattaggaacgtgggtacccatgttctta

SEQ ID NO: 6592 - DNA, 113 bp, Zea mays
gaggtgcgacttgacggcggggatggccggaatcgcccggtccacgagcgcaggcaggtgttctcgtcggtggcgagtgtaccggccaaaccacggcgatctggttcaatcca

SEQ ID NO: 6593 - DNA, 118 bp, Zea mays
taagatttgattagctggaacgattccgggatgaatcctagcgcaaacgaataggccctaagggcatgttcgctttttcaggaatgaacccggattcattccagctcatcaaaattta

SEQ ID NO: 6594 - DNA, 155 bp, Zea mays
gtctgacacgcttaaggccttgtttgtttgtaccagattggtgggtcgaaacaatttctaaccggattgcttctctaatttatataaactttgattagctgaaacgatttcaggtacaatccgacacaaacgaacaagacctaagagatagtgct

SEQ ID NO: 6595 - DNA, 82 bp, Zea mays
gggacatccgcttgctgagttgctcgatagggactttgtcgagacctccatcttgttgatttgctcggtagggacctagtcg

SEQ ID NO: 6596 - DNA, 132 bp, Zea mays
aagaagctgaaaataagctgtgccaaacagggcctacatgctgacgccaaacgcgtggaaaacaaaacaaatgtaacttaggcctgacctagtttttaggctctatttgtaacaacttatttttaggttctt

SEQ ID NO: 6597 - DNA, 71 bp, Zea mays
cttgccacatcggctgccacgtaagaaaagttggcaccaatggtactggcgtcgttgtgcgttacctcggc

SEQ ID NO: 6598 - DNA, 174 bp, Zea mays
aggagatccagcgccaggtgcagacgctgcttgataagggttacattcgtgagtctcttagcccttgctcggttcctgtcttactagatccaaagaaagatgggtcatagaaatataagatgcggacatcaacaccaacacgagcacatctacaccagcagcaccttctccagc

SEQ ID NO: 6599 - DNA, 207 bp, Zea mays
acagtaatcttaggatgtgtttggttgcaggacagctgggatagccgggaacagccacgtcccctctcgtccgttaaattttgacgaacagctagaggcagcaatgagatagtactgtcccaaccactgacactaaaccaaacaaccttatccaagagatggtcacatctcatcatgttattgcaaccaaacacactattagtgatt

SEQ ID NO: 6600 - DNA, 169 bp, Zea mays
  unsure (5): n = A, C, G or T
ggcgncataggctatggcgccgagcaaagggtccaaaaatgacattaaaattttttaagatctaaacgtgaatttttttccgaaaaatggctaaaatacaaaaaattcggtccagccgaaccctccgcggctttggacctccatcggcgccgccgtgtagttccgccag

SEQ ID NO: 6601 - DNA, 135 bp, Zea mays
aagagagttaaggctagtttggtgtgtggcctcccgcgccatgccgtgcctaagccgcggcggtcgaatctgctgcggtaaaactgtggtgcggtgtggcggattagtcgtgctaccaaacagccccttagtttg

SEQ ID NO: 6602 - DNA, 175 bp, Zea mays
ggtccttgccgcttggcgttgtgagcctgtaagcactgggggaagcttttgtcttgactataaaggggccctcccacctgggctccagcttgcccttggactccgtccgagctgtccggacgagtacgaggtccccctcgctgaactccctcgggatgactgagtggtcgcgcca

SEQ ID NO: 6603 - DNA, 78 bp, Zea mays
gttgatttgttggacaggaaaatggattcatgaatctccttgctattcaaaatccaattttctgtccaccaaaccagc

SEQ ID NO: 6604 - DNA, 98 bp, Zea mays
tggcggattccttcactatagggtcctcaaccttgtagatatctcgctcgaaatcctcatcagcttggtcgaagacctcatagtgccggcacccttcg

SEQ ID NO: 6605 - DNA, 199 bp, Zea mays
cacagatctgggagatgcacgaggctttggggaattgctcgtcggaagttggattaagccacagatctgcccctcaacattggcaggggcacctgtgccttattccatggtaaggatcttctcaaatgccttgcctctatccttagctcgtgtagcaccattcagattaaggccttgttcgtttgtatcggattgcacc

SEQ ID NO: 6606 - DNA, 226 bp, Zea mays
caagtgcatgtgggcttggcactcggcaaaggctctgttactgtcacttggcaccatcatagtgacttttatttgtcgagtgtcagatataaagtactcgacaaataggttgttgccgatgatcggttcactgagatctttttgccgagtactacactcggcaaacggcaaaccttttgccgagtgttattgaagctttgccgagtgtctgcaccacttgacaaag

SEQ ID NO: 6607 - DNA, 95 bp, Zea mays
tgttgtatttgtgacactcggcaaagagccccttgccgagtgtcaaaaaaagacaatcagcaaagaaactctttgccgagtgtcaaaaataaaac

SEQ ID NO: 6608 - DNA, 132 bp, Zea mays
ctataaatattttttctagactcagtgagcatacagagtgacgtgggtttaaacacaaaaagacgtcttaggtgaagttgtacacaattcacatgagttatgttggctagagggtggaaaagctagacattc

SEQ ID NO: 6609 - DNA, 73 bp, Zea mays
cactccagtcttcagtgactggcactacagacacctaattgtttgtagtagggggttacaaaagagtgagaga

SEQ ID NO: 6610 - DNA, 118 bp, Zea mays
tctattaacgggatgtttgggagtgaagttttttcacagaatcacacttttggaagaaatactgcagtattcttccaaaactgcagaaaaactttgttcccaaacaccccttagtagt

SEQ ID NO: 6611 - DNA, 124 bp, Zea mays
tgggtgggccgacgggaattaaaataaagcccgtcggctggcggctggccgacgggagttaaaataaagcccgtgggctggaattgagccgacgggagttatttaattcccgtcggcccaccca

SEQ ID NO: 6612 - DNA, 79 bp, Zea mays
ggcgtctgggccgtggctagtctgcgctcggtcggttaggcacgccatcgagcgtgtggcagcgctcggtctggtcact

SEQ ID NO: 6613 - DNA, 76 bp, Zea mays
tcggcagccagaagccgccgaaaataacctactttcggcggcaaagtggttattttcggcggcttctggccgccaa

SEQ ID NO: 6614 - DNA, 76 bp, Zea mays
ttggcggccagaagccgccgaaaataaccactttgccgccgaaagtaggttattttcggcggcttctggctgccga

SEQ ID NO: 6615 - DNA, 182 bp, Zea mays
cactcaccaagtcatggatgagaggagagtggtgtggagagccacacgcgcgcgttcgctcgccttgccagggcggggcaggcgaagacgcgggcacacgacatacgcgtgaatgtccgccgaattcggtccctcgccttgcgggagcgtgctcctttgccagcatccagatcatcccagtt

SEQ ID NO: 6616 - DNA, 127 bp, Zea mays
ggaatcagcttctttaccgtgtgtctgagacacactgcaaaggctatgttacactcggcaaagcatttgccgagtgtaaaatagcctttgccgtgtgtctcagacacacggcaaagaagctgattcc

SEQ ID NO: 6617 - DNA, 103 bp, Zea mays
tttgccgtgtgtctgagacacacggcaaaggctattttacactcggcaaatgctttgccgagtgtaacatagcctttgcagtgtgtctcagacacacggtaaa

SEQ ID NO: 6618 - DNA, 107 bp, Zea mays
ccgccttctttgccgagtgccatttgagacactcggcaaaacgcccgccagggagggtccccatgtcaggctctttgccgagtgtctcaactggcactcggcaaagc

SEQ ID NO: 6619 - DNA, 192 bp, Zea mays
ttatatagaaagatcttggcggcgaacatccagaggacaagcctaatttgttaatatcattatttccatatggtgacaaacaacctccgggtattgtcctgtgcggttattatgtatgcgaatggtgtcgtgtcaccttccattacatggtacaatcgtgaggatgtaagttcgctatcattgtctatgttg

SEQ ID NO: 6620 - DNA, 103 bp, Zea mays
tcttaagaacatgggtacccacgttcttaagttaagttcgtgggccctggataaaaccgtcgaacttaacgagttaggaacgtgggtacccatgttcttaagt

SEQ ID NO: 6621 - DNA, 225 bp, Zea mays
gacaggcggtgtgctcagtccacgatacgtgggccacgcagttactcaccattactcccgcattactcgtacggtaactgcccatcaatgcagcatggattgcggacatcaagactcccactgattactcatgcgttactctatcagcattagttattcacataatgtaattcttccattatgctcctgggcccacatgtcggggctcagcattctagtatgtgc

SEQ ID NO: 6622 - DNA, 106 bp, Zea mays
tgtttgaggaaaactttggttgagaccaattggctagagtgggactgagcatcaacgctctctttacacaaaaaaactttggttgggactaaaatttccaaaacta

SEQ ID NO: 6623 - DNA, 105 bp, Zea mays
aatctccgacggcctaaaaccgtcggacataggttgatgccgtcggacataggttatctccgacggttcaatccttatgtccgacggctttggtcgtcggaaatt

SEQ ID NO: 6624 - DNA, 201 bp, Zea mays
ggctaactgcgccacactttgtctaagcttagtcgttcaaattgaaaaactaatcttaaacataaaagttacacaaaatgtgataatttagtcatcaaaccaaacatgtcctagcttaccacactttgactaacttttctgtctaaggttagttatttaattgaaacgactaacattaggcaaagcatgacataattagca

SEQ ID NO: 6625 - DNA, 110 bp, Zea mays
tggtttgtggctaactatgccacactttgcataaggttagtcgttcgaattaaagaactaaacttagacagaaaagttaggcaaagtgtggcaagtgaggctgcgatcta

SEQ ID NO: 6626 - DNA, 73 bp, Zea mays
ggcccgagcgcaggcgccggaggtcggcggcggctcctgttccggccaaaccacggcgatggggttcaattaa

SEQ ID NO: 6627 - DNA, 76 bp, Zea mays
gtaccagatcaaaggcactcggcaaagtattttttttaattttaaaaaaaatctttgccgagtgccagatcgcggg

SEQ ID NO: 6628 - DNA, 92 bp, Zea mays
cgacaaagagttctttgctgagtatttttttgacactcgacaaagactttgccgagtgtcgaaaagcactcgacaaagaaaaaaaactcgat

SEQ ID NO: 6629 - DNA, 151 bp, Zea mays
aagtagatttaggccttgttcgtttgtgtcggattgcatccggaatcgttccacttaatcaaactttatataaattagaaaagcaatccggtcaggaatcgttccgatccactaatccgacacaaacgaacaagaccttttttttccaaac

SEQ ID NO: 6630 - DNA, 157 bp, Zea mays
agatatacagtctggacctccaagttggtccaggacccccacgtgtacgaaccggacccctagaatgggatccggaccccccccccccccccgtatggggtccggaccgcccacagtggggtcccaagaccttacttaaggcccaggcgggggtccg

SEQ ID NO: 6631 - DNA, 154 bp, Zea mays
aattccccgttagggctagtttgggagtcacaaaaccggtggggattggaggggctaagatcctctccttattcaattttgaataagaagggaattttatcccctctaatcccctccgggtttggaactcccaaactagccctaacggggaatt

SEQ ID NO: 6632 - DNA, 126 bp, Zea mays
agttttatctgtcaggatgcactagttatcgctgcttgcagcaagttatcttggcttctttgaagctagttatctgaagattgatcctacatcgtgaagatcgggcatcgtgacgcatcagggagt

SEQ ID NO: 6633 - DNA, 134 bp, Zea mays
ctaagggtctgttcgtttctgctggaacagaccaggattaattccaaatctccaaaacttatagtaattattgaaagaatccaagtcatatttattccacctctccattccctgcgaaacgaacagcccctaat

SEQ ID NO: 6634 - DNA, 118 bp, Zea mays
gcacgcaccggtccggttagtatagtgccagtccctggcacgatacggatatagtgtcgtgcctgggccactatctcgacctgtagtactggcacggacatgacacggttacattttt

SEQ ID NO: 6635 - DNA, 172 bp, Zea mays
ttgtcgagtacattttgtcttgcattcggcacagtcggctctgccgagtgccgcactcggcaaaatagtactctcggcaaagaaacgtttatcgagcgtgcgacactcggcaaagactaacactcggcaaatcagcctttaccgagtgtcggcgaaatgcaactctcggcaa

SEQ ID NO: 6636 - DNA, 181 bp, Zea mays
cggcgagagcggggcgtggagcgggcccgggggacgtgaccgggaacggccccctcgggggccttccccgggcgtcgaacaaccgactcaccaactggaacggacaaggggaatccgactgtttaattaaaacggagggggtgcgacggtcctcgaggatgctgacgcaatgtgatttctg

SEQ ID NO: 6637 - DNA, 179 bp, Zea mays
acccactcaggaaagaccaatcggcccagaagactagtcctatggggcaggtgtggctctccttttaaggtggtttcctcctcccaagttaagcgaggtgtgataattttaggctcacacggtcgatgtctgactataattgggcaaactgggccaattgcgtctttgccaatgggtaa

SEQ ID NO: 6638 - DNA, 159 bp, Zea mays
ctcaggtacatctaaatgagacagcggcttatttgaacctcaactggttacgcaacctgttcgaattgctacagctgttcagattactgcaagctgtaatacatagagataaaatactataaaaatcgcagccgcagtcggattaggacatatccagct

SEQ ID NO: 6639 - DNA, 66 bp, Zea mays
ccaacacgagtcttttgtgcgcactttgtcctcactcatgcgcacccgagaacagtgacaggtcgg

SEQ ID NO: 6640 - DNA, 158 bp, Zea mays
cgagggcagcgtctccgccatctagcgacgttttcggcaccaggtgactttgtcgaactggtccctcggagggcaaatgttggggcgaaggcaaagacgccacccttcgctcgtcgcctttcgctgcagtcgctggtttgacgaagacaaaacgggca

SEQ ID NO: 6641 - DNA, 123 bp, Zea mays
atcccgccaacgggaggcatctggtgaggggcatacttcgcccagcgcccagccatgcgccaagagccacaccccatacgcgacaaaactcctcaaccagatcgcgccccgctactcaggccg

SEQ ID NO: 6642 - DNA, 198 bp, Zea mays
gaaggtcacctttgtttttttggcccgttttcgtattaactgcatcattctatgaagtttcattaagcatgttgatacatggtgagataaatatcaagttagctttccaacgcatctagccccacgttatttggagattcctagaagaagttattatcaaaatactgaagactgcgcagaagtcaaacacccaccccc

SEQ ID NO: 6643 - DNA, 157 bp, Zea mays
caaacgagccctaaggctttgttcgtttacatcggattggtgggtcggaataattccgagccagattgcttctctaatttatataaactttaattaaccggaacgattccgggtgcaatccgatgtaaacgaacaaggcctaagatgaattgaagcg

SEQ ID NO: 6644 - DNA, 203 bp, Zea mays
tccgaagacttaggccctgtttggaagcacccagtttttaagaaatcggtttatataaattaagatggttccaaacatactagtttatgactcagtttatagaaattagattaccagtttcttaaaaaaatcaagaagctagtctagataaaaactgatttcttaaaaactgagttggttccacacaaaggccttaatggggc

SEQ ID NO: 6645 - DNA, 90 bp, Zea mays
tcattaccggaatcacgttctttgccgagtgtaaaatagcctttgccgagtgtcttagacactcggcaaagaacgcgattccggtagtgt

SEQ ID NO: 6646 - DNA, 79 bp, Zea mays
cgagtgtcgcactcggcaaagagggctcgacacacagcgtatcgacaaagccttctttgccgagtactttttctcgagc

SEQ ID NO: 6647 - DNA, 127 bp, Zea mays
gagttctaatggctgacagagagagaagtgagcacgcatagcttcgagcatgaactctctcgatcatacatcatgcaagaaaggcaccatgtgtgctcactctcttctgtcagctttcacctctcct

SEQ ID NO: 6648 - DNA, 99 bp, Zea mays
gtaccaagttctttgccgagtgtttttttcgggcactcggcaagaagcttcttttgccaagtgccacgcaaaaaacctctcggtaaaagaaaacacttc

SEQ ID NO: 6649 - DNA, 205 bp, Zea mays
aaatttacatctagaaacgaaggggaaaaataagttattctgatcggtgtcaagttgcataaaagaatattccacggaaatcaagagactcatctgacaaatgatatctgttgagagtttctaagacacttctaaaatctaaacattgactaaggcccctttggtagggcttatttttcagcttcggctctggctcatgcaaaag

SEQ ID NO: 6650 - DNA, 62 bp, Zea mays
cgcctatgccatgcggcggactgtgctcgttgtcccttcttcaagagtcttccccagcaagc

SEQ ID NO: 6651 - DNA, 72 bp, Zea mays
tgccgtgccggcacggcactagtgcctgaggctaggcccaagcacggcactaagcctgcttagccgtgccgt

SEQ ID NO: 6652 - DNA, 76 bp, Zea mays
tgtcgatgttccaggagtgctccaggtcctcgccgtttggcgttgtgagcctgtaagcgctggtggaagcttttgt

SEQ ID NO: 6653 - DNA, 141 bp, Zea mays
ccaaacagaccgtgcttgctaggcggtccgaaacatggcacaggtttggcccggcacgacacgtagtgaaccgggcccgtgccggtccggctcagtcaccgagccgtgcctggaccgaaggcgtggcacgaggggctaggc

SEQ ID NO: 6654 - DNA, 127 bp, Zea mays
  unsure (114): n = A, C, G or T
gcaggtgtgccggccaaaccacggcgacctagttcaattcaatggcacggtgagcttcacggggtgatgtagaggctatctgtgcattgaatcgaaaaatggtgcagtgatttncccagtccacgtg

SEQ ID NO: 6655 - DNA, 98 bp, Zea mays
tgggttaatttaagaacgtgggtaccaacgttcttaattgagttatgttcgtgggttaatttaagaacgtgggtacccacgttcttatgttaaattcg

SEQ ID NO: 6656 - DNA, 113 bp, Zea mays
ggtgtatggctcgacggcgggagtggccggaatcgtctggtccacgtgcgcaggcaggtgctctcgtcggcggcaggtattccggccaaaccacggcgatctagtccaatcca

SEQ ID NO: 6657 - DNA, 132 bp, Zea mays
gcgacctgcacacacctgatggcgttcgcagcctctcccttgctgccaaggatcatcacccacatatagcgggagagatcgtcgatgagcaacaagaagtagcgtcgtcctcctggtgtggctggtgtcacc

SEQ ID NO: 6658 - DNA, 106 bp, Zea mays
cgagtgtctaggtatgacactcggcaaagagggctttgccgagtgtctattacgtagcactcggcaaagaagcctctttgccgagtgccagccgttggctctcggt

SEQ ID NO: 6659 - DNA, 95 bp, Zea mays
taagcgagccgctaacttcctagagacggccgtaggaagttagcatgtgcagctaacttcctacggctgtctctagtaagttagcatgggcagct

SEQ ID NO: 6660 - DNA, 84 bp, Zea mays
agtgctagggccatagcactcggcaaagaaactttaccggtgcccaagtgttccttctttgccgagtgctatggccctaacact

SEQ ID NO: 6661 - DNA, 84 bp, Zea mays
agtgttagggccatagcactcggcaaagaaggaacacttgggcaccggtaaagtttctttgccgagtgctatggccctagcact

SEQ ID NO: 6662 - DNA, 134 bp, Zea mays
ttccattgtgcaagcaagattggtcggattagcccacttttccgtgggttatatattcacttatgcagctttcttgattgcctcaacatcaggcaagtttggttaatttagttatttttttttgtactgtatca

SEQ ID NO: 6663 - DNA, 175 bp, Zea mays
acactattaggtgagtgtccgtgcgttacaggcctgagtttctctttgatatcattccggatggcttgtggatattatcatccatctcataatcgtataacacatatttgtatatataagttatcgagatattatatgttccagatgcaatgcacgaacactgacctatcttata

SEQ ID NO: 6664 - DNA, 161 bp, Zea mays
ctctacttctcttggtccgttagatctagatccaagcatatatgtaatcgtggtttgttaggggcgtctttataaaactacacgaggtagtggtagaaggatttaaatgctaaatatggtatacggttagatctagatctaaccgaccaagagacatgctt

SEQ ID NO: 6665 - DNA, 92 bp, Zea mays
acgcggcctggtagctcggcgtcacagatctaggcgccgagctacgaaagctcggcgccacagatcttggcgccgagctgcgtctgccctat

SEQ ID NO: 6666 - DNA, 210 bp, Zea mays
taccggaatcgcgttcttttgccgagtgtctaagacttgacaaaggccattttacactcgacaaaagctttgccgagtgatacactcggcaaacaataatcggcaaaatatttggcactccgcaaaggctttactgagcttctttgccgagtactcgaaaaaacacttggcaaaatatttggcactcggcaaagaagcaaatttctggta

SEQ ID NO: 6667 - DNA, 189 bp, Zea mays
ctacgccacctgcgaaggccctgacgctgtgggagcctccgccgttggctccgccgttggttccgccgctgcctccgccgttgtttccgccgccaccgccgcgggatcttcagcactcggcacagcagctgcgggggcatcaggggcgccttcggccaccttcgggggcaggtcttcgctggccgcagc

SEQ ID NO: 6668 - DNA, 89 bp, Zea mays
ccgtcatcccgccgagatgccagcctaaggatgctcgcgtcccatcctccccgacatcctttgcgccgtcattctcgccaccgccgctc

SEQ ID NO: 6669 - DNA, 82 bp, Zea mays
gcgccagggccatcctgcagacggcgtgcatgtccagtcaattgtcaaacaatgcgctcgtgctgcggggtgcactgtgtcc

SEQ ID NO: 6670 - DNA, 75 bp, Zea mays
ggcatggcagtggcacgagcgtttcaggcaccttaacttcgaggccctgaagcggctcagtgacaaggagatggt

SEQ ID NO: 6671 - DNA, 82 bp, Zea mays
gtgtcagggccataacactcagcaaagaaccaatacctaggcactggtatagcttctttgccgagtgtggtggccctggcac

SEQ ID NO: 6672 - DNA, 93 bp, Zea mays
accgtgcctaccaattaaccgtgccgggcccgtgcctgcaccgcgagcccgacggccagcccaagcccggcacggctattggaccgggccggc

SEQ ID NO: 6673 - DNA, 147 bp, Zea mays
tcaggtatgtatggcctgtttggttcgtggctaattatgtcacactttgcctaaggttagtcgttcaaattgaagaactaattttaggcagaaaagttaggcaaaatatagcaaattaggcaacgagccaaacaggcatgtagtgtt

SEQ ID NO: 6674 - DNA, 84 bp, Zea mays
tcaaagagtggacgacgacgacgatgacgatgatgtttatgcaccgctgcgacaacgcctcgcacgtaatcgtcaggatgggag

SEQ ID NO: 6675 - DNA, 126 bp, Zea mays
gaaaatcttagtttatcagaagcttggtctaaaattcccgaaaaattagccttttatgattatattggtaataatccggcaaaggggggattattcagagcaggctcaatggacaatggggatggc

SEQ ID NO: 6676 - DNA, 187 bp, Zea mays
gaccaaggcgagagcaggctcggatgagtgactacacgcgccagaacttgggcagaacgcacgggcacacgtgttcgaccctggtcggcacgccagagctcgcccaacccgcgcgcgcgctcgccctggcgtccggtcaagtccgccgcgcgcccacgccctcggtcgtgcccgcccgcgcctataa

SEQ ID NO: 6677 - DNA, 95 bp, Zea mays
gttgagtgccacctgatactcggcaaagaaaagtcgtcgtcgcggctctaagtgacggttacagagcctttgccgagtgtcagttggactagcga

SEQ ID NO: 6678 - DNA, 74 bp, Zea mays
cgatttctaaccggattgtttctctaatttatataaattttgattagctggaacgattccggatgcaatccaac

SEQ ID NO: 6679 - DNA, 230 bp, Zea mays
ggtaaagacgttctttgccgagtgccagatatttaacactcggcaaagagtatgctttgccgagtgccggccttcggccctcggcaaaggctgacggccgtcagctgtagacgaccgctaacggccctttgccaagcgccatctttgcctagtgtttgccactcggcaaagcagtatttgccgagtgtttctctgtgccgagtgtcccgcactcggtaaacaagctcttt

SEQ ID NO: 6680 - DNA, 130 bp, Zea mays
tcggcaaagaggtgctttgccgagtgtcaggaccatagcactcgtcaaagaaccaagacctgggcaccggtataggttctttgccgagtgcagtggctttggcactcggcaaagaagctcgctttgccga

SEQ ID NO: 6681 - DNA, 122 bp, Zea mays
caaagcgagcttctttgccgagtgccaaagccactgcactcggcaaagaacctataccggtgcccaggtcttggttctttgacgagtgctatggtcctgacactcggcaaagcacctctttg

SEQ ID NO: 6682 - DNA, 231 bp, Zea mays
tgcacatagaagactggtgcacatgatgcacatattaaatcatcaccattcattttagatctaacgtctttagttgattgttcaatttataaataacacattccaccactacacaccaccacgttagagggtgtccttagtaaaatgtaccaaacaactaaagacgttagatctaaaataagtggttatgatttaatatgtgcaccatgtgcatcagtgtttcatgtgcac

SEQ ID NO: 6683 - DNA, 87 bp, Zea mays
agcggtatgtgggaccactttcgtctgtacgactgggccggagaccacgacatggttgatgctgcggtagtggtctcgcttctgccg

SEQ ID NO: 6684 - DNA, 167 bp, Zea mays
tccgtcagccgtccccgacgtggacgagccaacttcaaaggatctcattgacggagaccgagtcttcgccctacaggctctatatttataccaagcccagaccaaagcatggcgtgaccacacggtcatcccgagggagttcagcgaaggggacctcactccccccg

SEQ ID NO: 6685 - DNA, 149 bp, Zea mays
ctgccgcctgaggtcttgtttgtttgtgtcagattggtgggttggaacgattgctagccggattgcttctctaatttatatacactttgattagctggaacgattccgggtgcaatccgacacaaacgaacaaggcctgacttagactt

SEQ ID NO: 6686 - DNA, 103 bp, Zea mays
catctttggtagccagggatgatttgcctgtggttcctgtcgttgccatgccaatgcctgtactgttcgatctacgggcaaatcatccctgctaccggagtgt

SEQ ID NO: 6687 - DNA, 166 bp, Zea mays
caacccgaatgcaacccagggtgtttgaagctcctcacgaaaaggagaacatgtcccacctgtagatcccccggataacgttttagttgttgttgctgctgctgcgggtggggtgtattatccttttagtgaggggttgtaaacactttgatttgcattcaggctg

SEQ ID NO: 6688 - DNA, 148 bp, Zea mays
agtatagactaggtgagtgaccgtgcgttgcaacggaaacatatatcacgataatttataataatataactcatttgtacataagttatcatgataagatcctctctatggacataagcaacgcaaaggcactcatctagtacacaac

SEQ ID NO: 6689 - DNA, 91 bp, Zea mays
gtggcacgtacgtcggcgccgtagatcttgccaccgaggtatgcgccatggatctcggcgccaagatctacggcgccgaggtacgcaccta

SEQ ID NO: 6690 - DNA, 141 bp, Zea mays
gcaaaatagcttctttgccgagtgccaacgtctagcactcggcaaagttaacgaccgttagcttgagacagttgctgattaccctttgttgagcatcgccgttcgttgagtgtttgacactcagcaaagaggttattgccg

SEQ ID NO: 6691 - DNA, 140 bp, Zea mays
taacaaatcggcccacttgccctttttctcatcgaggagcatcttattgacagctggcatcagaagccatttgcgcgttccacaactccgttaagagctattacgatactgaggcgaaggcaagcttgcagcctgcagtc

SEQ ID NO: 6692 - DNA, 71 bp, Zea mays
atctactcctgggaagagctctgtgcacggttcacagcgaacttcgccagtgcttatcagcagcatggtgt

SEQ ID NO: 6693 - DNA, 222 bp, Zea mays
cacgacagacgaactaagtcgcagcgaggtcgacgacgagatagggattaaggccgagcgagccgagagggcgcgcaacgagcaagaaaaagactcgacgcgggagtttgacgcgcacgtgaagctatcaccagcgacaacacgacgatggcgatatgagcgaacgtgaatcggcgcgggccaaacaccgaacaaccatggcagcgacttgggtgagatcca

SEQ ID NO: 6694 - DNA, 85 bp, Zea mays
tacctcggcgccatagatcttggcgccgaggtacgcgcccgatcaacgacactacctcggcgccaagatctacggtgccgaggta

SEQ ID NO: 6695 - DNA, 150 bp, Zea mays
gtcgagtgcctcagacactcgacaaacgttttaccgagtgccgcactctgcaaagagatctagtaaaaaaatcatcggcgaaagattctttgtcgagtgctttctatcgggcactcggtaaagactttgccgagtgctgaatacatactc

SEQ ID NO: 6696 - DNA, 100 bp, Zea mays
ggctcaagcctcccacattcgctggatctagcaatcccctcatcttattattgtctatcacgattaaaaggaagttggaagccatcggatgccggagatc

SEQ ID NO: 6697 - DNA, 94 bp, Zea mays
gtggtatctcagccggatgtgcttgctccgttcatggaacacggggttcttggccaatgccagagcggaggggctgtccaccctgagttccacc

SEQ ID NO: 6698 - DNA, 71 bp, Zea mays
gtgccagatcggggacactcggcaaaggactcggcaaaggagcctttgccgagtgtcacctcggcgacact

SEQ ID NO: 6699 - DNA, 183 bp, Zea mays
cccggcacagtcagcaggtcgacatgacgtgtctgggcccagagttgtggtccgtgagcgtctggcccgtgccgggtcgccgtttggccatctataggcgtgcaacggatttaatttgaaatagctatgaggggttatttgtaaaaagatgacgcatgacgaccgttgaaaactggtgcttta

SEQ ID NO: 6700 - DNA, 157 bp, Zea mays
ggaggggcttaccggcggtgagattgctccggtgaagtggtcgagggtgtaggggaggtcttgacggtcaccccgatgtgcggatcgtctccggcgatggtcggattcggtcggtccacgcgtgcaggcgggcgagctcgtcggcggcgagggctcc

SEQ ID NO: 6701 - DNA, 113 bp, Zea mays
tggttctgccacagctggtatcggagcaaattccaccacagagaaggacaataaaccatgaacaccaattttcaaaatctaaaacttgcctagaaactgctatggaacgtcag

SEQ ID NO: 6702 - DNA, 98 bp, Zea mays
cggcggattccttcactatagggtcctcaaccttgtagatatctcgctcgaaatcctcatcagcctggtcgaagacctcatagtgtcggcatccttcg

SEQ ID NO: 6703 - DNA, 130 bp, Zea mays
  unsure (1): n = A, C, G or T
nctgggcgctaaacacgactgagtgcagggcgactgggttcacccctttccgccttctatatggatcggaggccatgaccccacaagaaataaaacatgggtccccgcgaacagttttgtcagctgtccc

SEQ ID NO: 6704 - DNA, 208 bp, Zea mays
cattatgtgtaagcgtgcaagtagctcttattggttcattagatctagatccaaccgtacgtgtaatcgtggtttgttaggggttttaggggctttttttataaagctacacgaggtgatgggagaaggatttaaattataaatatgacataaggttagatctagatctaatggatcaagagacctacttgcacgattgcacataatg

SEQ ID NO: 6705 - DNA, 75 bp, Zea mays
ggcgtcccacgtgtaagcgatagcggcgaggaaataggaacgcacgcccgcggaaatcgcgcacaggttggcgcg

SEQ ID NO: 6706 - DNA, 95 bp, Zea mays
caagcgagccgctaacttcctagaggcaaccgtaggaagttagcatggacagctaactttctacagccttctctaggaagttagcttttaattgc

SEQ ID NO: 6707 - DNA, 187 bp, Zea mays
gaccaaggcgagagcaggctcggatgagcaaccacacgcgccagaacttgggcagaacgcacgggcacacgtgttcgaccctggtcggcacgccagagctcgcccaacccccgcgcgtgctcaccccggcgtccggtcaagtccgccgcgcgcccacgccctcggccgtgcccgcccgcgcctataa

SEQ ID NO: 6708 - DNA, 90 bp, Zea mays
atgcgcctgcccctgcctattttcgagcgcccttctcttgtctgtacgaggctggctcgggcgagacggactgggcagaggcgacatctg

SEQ ID NO: 6709 - DNA, 241 bp, Zea mays
tggtggaggagttgcgcgccggcgactctgttgattttggtgtgtcacggatgacgtcagcccgcgttgaagatatgcagcggttgggctactttggcggcggagttgctcgtgctccggggacggaggaggtccccgagccggagggtgagttggtcgttttcgaggcgttcttcgccgccggtctccgcttgcctgcgcaccggtttgttggcgaagtcctgcgtagattcaacgttca

SEQ ID NO: 6710 - DNA, 83 bp, Zea mays
gagcatttaccgagtgtcctaccagacactcggcaaaggcttcctctttgtcgagtgtctgctggactaacgctaggcaaaga

SEQ ID NO: 6711 - DNA, 94 bp, Zea mays
acattgccttatgtccgacggcccgccacctagccgtcggacattagcttatgtccgacggcctcgtaccgagccgtcggacataaggcttttt

SEQ ID NO: 6712 - DNA, 117 bp, Zea mays
ggacggctggcgtgccgatggtgtgaaagaacacgtcggagggcaggggctcgcccctggcggcggccttggctaatgcatccgcctcctcgttcttggccctatccacatgctgca

SEQ ID NO: 6713 - DNA, 127 bp, Zea mays
gcaaagagttagcctttgccgagtgtccactgtactaacactcgacaaatatgctccacgtggaccccttttgcttgttcctttgccgagcgtattaggtggcactcggcaaaggcttcctctttgc

SEQ ID NO: 6714 - DNA, 74 bp, Zea mays
ttgtttatatgcattcatgtgcattatgcaaatcatttaggtacgtttgttgatcacgtgatgtagaaaacgac

SEQ ID NO: 6715 - DNA, 77 bp, Zea mays
ggtagcgagactcgacggtgaacggcgcgacgatgaactaagtcgtggcgaggttgacgacgagatagggattttaa

SEQ ID NO: 6716 - DNA, 78 bp, Zea mays
ctacggttctcacccaaatgaggcctgctggccacctttcaggtgaccaatcaggagcattttgggtggcctaatggg

SEQ ID NO: 6717 - DNA, 102 bp, Zea mays
agacctcatcgacggagacagcgtcttcgccctgcagaccctcgacaaataccaagctcaaacgaatgtctgttacgaccacgcagtcgtcccaagagaatt

SEQ ID NO: 6718 - DNA, 145 bp, Zea mays
taccggaattcggctttttgccgagtgttaaatgatttgccgagcgttttttttcgggcactcggcaaagaagctctttgcggagtgcccaaaagaaaacactcggcaaatcatttggcactcggcaaagagccgaattctggta

SEQ ID NO: 6719 - DNA, 128 bp, Zea mays
actgcaaactaaaatgtttgcagtccctcataaaaaggaagatagacatcacttagttgtgttattgcttctgcgggtgaaatctattctcctttttgtgagaggctgcaaacattttggtttgcaac

SEQ ID NO: 6720 - DNA, 125 bp, Zea mays
actatcccctaaacactgtgttgtgggtccacgagtaattgttagtagataaaaaattgatagttaatatagaaaatgatattttataattgtagtggggtataagggagtatttaggggaaccg

SEQ ID NO: 6721 - DNA, 172 bp, Zea mays
cgacccagcacgaccaaaaaatactcgggccagcacaacacgttacgtgggctgggccgtgcttcggttttcggcccgacggcccaagtagcccggcacgccatagtgggccgtgctcgggccagcccggcacgatttagggttagggttattttttggacgtctcacgcag

SEQ ID NO: 6722 - DNA, 116 bp, Zea mays
ctgctatgtccgacggctaagtaccgtcagagataacacagggccgtcggaaataatctatttccgacggtttcgagcttatgtccgacgactttggccgtcgaagatcctatgtt

SEQ ID NO: 6723 - DNA, 103 bp, Zea mays
agttcaaaatgtgggtacccacgttcttaaattaagttcatgggccctagccaaaatcgtcgaacttaactcattaggagcgtgggtacccacattcttaaag

SEQ ID NO: 6724 - DNA, 221 bp, Zea mays
cacacaattgtggcgcgtaacacaaccagtttggctatgttagctaggaccaactttggggatgtcgtagtgctcgctgaggtttgccagatattggttgaagtcctggatgcggtctctgtgcgacttgttggcgactttggccatcttctgcatgtcaatcttatgcttctgttccatgtagcatcgctctgctggtgtgagatggtcatagtcaggat

SEQ ID NO: 6725 - DNA, 143 bp, Zea mays
atctccattagcccttgttgatttgtgttggattgggtcggaacgattactaactgaattgcttctctaatttatataaactttgattagctgaaacaatttcggatacagtccgacgcaaacgaacaagaccttagggattg

SEQ ID NO: 6726 - DNA, 111 bp, Zea mays
ggtgagtgtccgtgcgttgcaacggaaccatataataacacgataacttatgtacatatgtgtgttatattgttataggtatgtgtccgtgtgttgcgatggaagtaaaaa

SEQ ID NO: 6727 - DNA, 238 bp, Zea mays
atttcccgagccgggacgtggcggcagacggcgacgttaggaagtccggagacgccggcgggggcctcgggaagagttatcttttctgcttaacggcccgccaaccctggaatcggttcagccggaggtagggtccagcgcccggaagagcaccgcccatctcgcggtgtccggtgcccccccggcggcccttgaaagtcccctggcccgaattccgtccacgcccggtactcttatt

SEQ ID NO: 6728 - DNA, 114 bp, Zea mays
gggaggatttagagtggttcaggccaccggagcgtaataccctactccactgtgtgttggattcttgaggaagcttgtgctgtgtgtaagcctgaatgaccttcgtccttgtct

SEQ ID NO: 6729 - DNA, 80 bp, Zea mays
agtgcctccctgcgcacttggcaaatgaactgccaaagggacccacttgagccttctttgccgagtgccagtccaacagg

SEQ ID NO: 6730 - DNA, 104 bp, Zea mays
atatcacgttgctggctccgtcttcacttgactcttggaatttcttgatgacgcacggatcgacgacgaccttcaattgaagtctggagcgagctggtgaggtg

SEQ ID NO: 6731 - DNA, 253 bp, Zea mays
cggacatcaagtactcaccaaactttttcagtattacactagacatagcactagataaggaagtcagagatgtctgcaagctatatatttgagtggtatactcactagacgtgtctggtgaggcatcaaatatagcactaaataccaatacagtaatgacttgtttctgaaataagtcattagagctatatcagacttatctagtgtagagagtaggtgtgcactggacatgtttggtgccgctatgaatgtt

SEQ ID NO: 6732 - DNA, 138 bp, Zea mays
cctagtgcatgtttggtttgtggctaaatatgtcacactttatttaaagttagtcgtctgaattgaagaactaacattagacagaaaagttatttctatatgtgataacttagaacacgaaaccaaacatgcctctaa

SEQ ID NO: 6733 - DNA, 146 bp, Zea mays
gacctcgtaaggcttttttcgtttgtgccggattggtgggtcggaacgattcctaaccggattgcttctctaatttatataaactttgattagctaacatgattccaggtgcaatccgacgcaaacgaacaatgcctaaggcttat

SEQ ID NO: 6734 - DNA, 169 bp, Zea mays
atttgaggaatgaacccatgatgcaccacctcaatttggatgtagtgattctttaaaccaaaacacccccctttaattccttaaaccaaacacactctaatggtgtgtttggtttgtggagtcactctattcttcatgaggtgatgcatcataagtttattccatcaat

SEQ ID NO: 6735 - DNA, 143 bp, Zea mays
aacatacatgtagggctagtttgggagccagaaaaccagagtagagtggattggagagaccaaaatctccttaatcaaaattgaataagaggcgattttagtccttccgatttttttggctcccaaactagccatgtatgttt

SEQ ID NO: 6736 - DNA, 174 bp, Zea mays
caagtggccaaagcactcggcaaagaaggcacacctgagaacaattaaaacttctttaccaagagttgtggtcccggcaagaagaacactttgccgattgcctcatagtgcactaggtaaagggactggtaaaggggtccactggtgcattctttgtcgagtgtcaggcaggca

SEQ ID NO: 6737 - DNA, 157 bp, Zea mays
tgttttttcgggcaatcagcaaagaagctctttaccgagtgccatgcaaaaaacccccggttaaaataaaacacacgacgaagaagctctttgccgagtgttttattttgataactcgggcaaagagcttctttgccgagtgtcaagagtgtcaaaa

SEQ ID NO: 6738 - DNA, 109 bp, Zea mays
gagctcttcaaaacaggaccttgggtcttagttcagtgatgcagaaataaattggctgagcgagtgccaatcgaagcatgatactgtacctgcaggacctgacagcagg

SEQ ID NO: 6739 - DNA, 218 bp, Zea mays
aacgcttcgagtggtcctgcgcgggcgggtgccttggtggtgtactggtgtgtccccgtagccgtaccgtggcacgccggatactctagcaagtgctcgcaacggcgtccttgtccgtcagttaaggctaggaccaggccgtacctgagagggtgcagtggtatcggagtataggtatacactaggtatgtgcccgtgcgttgctacggtttctataa

SEQ ID NO: 6740 - DNA, 225 bp, Zea mays
tccgacggctgaggcaaggccgtcggacataagtgaagtgggtctcacccgcgaccgttaaaacggttaccacgccttatgtccgacgggtggttgtggccatcggacatactgctatttccgacctgctatgtccgacggccatataccgtcggagatagcccgacgccgtcggacataagatatctcacggcttatgtccgacggctttgtccgtcggaattt

SEQ ID NO: 6741 - DNA, 78 bp, Zea mays
atttatggtcgtttcggcctaggtcttagctaatttctaggtccgccactcagaaggttacaatagggcaatgggccg

SEQ ID NO: 6742 - DNA, 216 bp, Zea mays
cttgcaaggtaaacctaaacacacgacgtggcgaggcactccgtcctgacacatatcaatcgtccccatcgattccccgtcaacagaacagggctcaccgcctaggcgtacaatgcctcactgaccccgactgccgtcgtgcagtgaccgcacttgtacccaccataaccggaatgggagaccacgtctcacgtcgtgtgaggggtaaagtctact

SEQ ID NO: 6743 - DNA, 92 bp, Zea mays
tggaaaaaaaacacttgggaaagagctctttgccgagtgttgtatttgtgacactcaccaacgacctctttgccgagtgtccaaaataaaaa

SEQ ID NO: 6744 - DNA, 82 bp, Zea mays
aaccaccactggggccgtttcaatcgctttctaccatagacttctctagtcaaaaccggttgaaccgcccctagagccaatt

SEQ ID NO: 6745 - DNA, 113 bp, Zea mays
cagtccctcacaaaaatgaggataggccccacctgcaagttcaccagataacatttttgttgtattattgacctgcaggtggggtctatcctcatttttgtgaggggctgcaa

SEQ ID NO: 6746 - DNA, 84 bp, Zea mays
cgtcatcattgacgccgaggtaacacatagtggcgccaacataattggcgccactatgtttttatcttggcgtccatgaaggac

SEQ ID NO: 6747 - DNA, 188 bp, Zea mays
gaccaaggcgagagcaggctcggatgagtgtctatacgcgccagagcttgggcagaacgcacgatttttttgtgttcgaccctagtcggcacgccagagctcgcccaacccgcgcgcgcgctcgccccggcgtccggtcaagtccgccgcgtgcccacgccctcggccgtgcccgcccgcgcctataa

SEQ ID NO: 6748 - DNA, 81 bp, Zea mays
ccttccaatagacttcacttcaagttccacaatctataaaagatcatcttgtagtgcttctgagtagagtcttctgataga

SEQ ID NO: 6749 - DNA, 159 bp, Zea mays
cacgctgcccctgcggctactgtgtccggtggtggctcgtcgccaaccgttgtgccgagggtggaggatcccccgaaggcggcgacggagccggcagcggaggatcccatggcggcggctgggtcttcgcaggtggcttagtgggtgtggggtagttag

SEQ ID NO: 6750 - DNA, 126 bp, Zea mays
gcgcaccgatttgttggagaagtcctgcgcagatataacgttcagatccatcagttgactccgaatgtcgtggtggctctgtcgaagtatgtctaggcgacgacttcgtacggcgaacagccatca

SEQ ID NO: 6751 - DNA, 168 bp, Zea mays
aagttaagcgtgcttggcttggagcaatatgggatgagtgaccgaccaggaagttttctctcgggtgcgcatgagtgaggataaagtgtgcacaaaatactcgtgttggtctgtggggacgatatatgatcctagaaagctgccaggagtaagtatcaccagtccagg

SEQ ID NO: 6752 - DNA, 156 bp, Zea mays
cactcaccaagtcatggatgagaggagagagtgcggagagccacacgcgcgcgcgctcgctcgcctcgcctggcctggccggacgaagggcgcgggcgcacgacatgcgcgtaaatggtccaccgaaatccggcccctcgccatgcgggggcgtga

SEQ ID NO: 6753 - DNA, 93 bp, Zea mays
cagtacaacatgtgcagtactagtcaatgacgtgttggcctagtggagggcaggtccacacgtcagtgactggtactgcacgggcagtactgc

SEQ ID NO: 6754 - DNA, 164 bp, Zea mays
agattatagggcagcccactacggtgtagtatatttgagtcacttgagacggtactctatagttttttgacaaaattttatgaaatatggcactgttggagtaatttttcctgtgtagagtcctatatttcaatttaaggcactagtttgaggcattgttggag

SEQ ID NO: 6755 - DNA, 186 bp, Zea mays
gacctggtccggctcgaccggattgcaccgttcgacctgggcttcctctagttattggaagcccagggctcttaatatataaactatatatatatatatattgattgtatattacaaggcatggacttctaataactagagtaagccctgactcaatggtaccgtccggttcaatcgaaccaagtt

SEQ ID NO: 6756 - DNA, 171 bp, Zea mays
gtccaagcctgccacgctacagttgataaccatggcgtcgatgtggggggcgctgcgcagatcgacgtctcgggcgtcgaaggttatcggcagatgggaccacttcgtctgtatgaccagaccggtgttggcgacgtggttgatgctgcggtagtggtcacgcttctcccg

SEQ ID NO: 6757 - DNA, 194 bp, Zea mays
ccgagcgccatctttgccgagtgcttgccgctcggcaaagcagtctttgccgagtgttcctctgtgccgagtgtcccgcactcggtaaataagctctttatcgagcgcaggactttgccgagtgcggctctcggcaaaatcttcttttgccgagtgcccgataaaaagcactcggcaaagatcttggcactcgg

SEQ ID NO: 6758 - DNA, 148 bp, Zea mays
gagccgacttaggccttgttcgtttgtgttggattgcacctgaaattattccacctaatcaaagtttatataaattagagaaacaatccggttaggaatcgttccgacccaccaattcgacagaaacgaataagaccttaaggtagga

SEQ ID NO: 6759 - DNA, 213 bp, Zea mays
ttctgcacgtgtgctggtcaagtcaccgtccagcgtggaagggaatgccgaaagacctcctgcccctccttatccattcaggtacgcgtgggctcaacaccattcttctccaccagaatgttgtggccacacatgcctaaatggatacaacagggacagagaggtattttggcattccccctgagggtgacttggccagacatgcatgcaaaa

SEQ ID NO: 6760 - DNA, 79 bp, Zea mays
ggaagcccaggccgactactcctacaaattggttcaagcaaagcgcccaaccagcctgtcgggtgcgtcacctgcccca

SEQ ID NO: 6761 - DNA, 123 bp, Zea mays
cagttccgccacagctggtatcggagcttgtaccaccatagaggaatcaataaaatgtaaataccatcaattttctaaataaaacttgatagaaacaaggttggatagatagtaggacgagca

SEQ ID NO: 6762 - DNA, 77 bp, Zea mays
aagggaacgggctgggcagaatcagcgggaaaagaagacccctgttgagcttgactctagtccgactttgtgaaatg

SEQ ID NO: 6763 - DNA, 78 bp, Zea mays
tagcacaagttacgaccgatttcaggagcggaccggaagcttttccacgggttgcttcggcattggttcatccttctc

SEQ ID NO: 6764 - DNA, 183 bp, Zea mays
gtgcggcgcgagagcaggctcggatgagagaccacatgcgccagaacttgggcaggacgcccgggcacacgtgttcgaccctggtcggcacgctggcgctcgcccaacccgcgcgcgctcgccccagcgttcagtcaagtctgtcgcgcccttgccctcaaccgtgctcgcctgcgcctataa

SEQ ID NO: 6765 - DNA, 83 bp, Zea mays
tatggttttgggtcaagtagactcggtctttgagcacccgtcatgctgcagctcgaggacgagctgcttgtccaggaggggta

SEQ ID NO: 6766 - DNA, 253 bp, Zea mays
cggaaatcagctctgcagatctcccgaagactgctccttcacattagctcgtgaaaatacttttgttttgtgtttatacctcgctaaggctggttgttactagtataaataccccctatttctatgatgtaaggcagcttatgataatctaaaatagaacccctttgttcagttgtgtgtttacaaatattgagagtgatctctacccctttgctcttgtgaattccttcgcgggattgcagaagcggcgtct

SEQ ID NO: 6767 - DNA, 258 bp, Zea mays
cggcacatctgttaaaagataacgcacgtgttctaagatgagctcaacgagaacagaaatctcgtgtggaacaaaagggtaaaagctcgtttgattctgattttctgtatgtattacgaactcgtgaaagcgtggtctatcgattctttagatctttcggagtttgaagctagaggtgtcagaaaagttatcacagggataactggcttgtggcagctcagcgttcatagcgacgttgctttttgattctttcgatgt

SEQ ID NO: 6768 - DNA, 80 bp, Zea mays
tttcaccgagcttgactctagcgtccgaggctccgtcaagtttggggatgcctccggcgtagagatcaagggcgtcggta

SEQ ID NO: 6769 - DNA, 157 bp, Zea mays
tctgagtatcgagtgacactcagtaaagtttttgccgagtgtctgataaaaaatattcgacaaagaaaccgttgtcgatatgcaatttcaccgagctttttttgtcgagtgtcacactcggcaaatacttcgccgagtgtttttcagacttttacaa

SEQ ID NO: 6770 - DNA, 193 bp, Zea mays
gggttacatcggcggcggagttgctcgagtcccggggacggaggaagtccctgagccggagggcgagttggttgttttcgaggcgttcttcgcgccggactccgcttgcctgcgcaccgatttgttggcgaagtcatgcgcaagttcaacgttcaaatacatcagctgacaccgaatgccatagtggctctgt

SEQ ID NO: 6771 - DNA, 222 bp, Zea mays
gagtgtcgtcctttgccgagtgtctgcgatctggcactcggcaaagatttttttaaaatattaaaatattctttgtcgagagtgtcctttgccgagtgccagctggatgacactcggcaaagaatcttttataatcctttgtcgagtgtctccctgctggcactcggcaaagcatgcttttttgccgagtgtcatttgtggacactcggcaaattatttttt

SEQ ID NO: 6772 - DNA, 106 bp, Zea mays
cgagagtgtcctttgccgagtgccagctggatgacactcggcaaagaatcttttataatcctttgtcgagtgtctccctgctggcactcggcaaagcatgcttttt

SEQ ID NO: 6773 - DNA, 106 bp, Zea mays
aaaaagcatgctttgccgagtgccagcagggagacactcgacaaaggattataaaagattctttgccgagtgtcatccagctggcactcggcaaaggacactctcg

SEQ ID NO: 6774 - DNA, 111 bp, Zea mays
aacttcagcctctcctccatgggagtgtaagctaggttgcagtcggtgagcctgcccaactcattgatgcgcttggcgtaggcggtctggcgaagtgagacgctggagctg

SEQ ID NO: 6775 - DNA, 132 bp, Zea mays
atgcctagtcccctacctggcgcgccaaatgtcggagagcaaatccccggccgggtggcggagtgcacccaccctaaatcctaagatgaggaggggcctagatgttttgcttgttagttgggaaagtgggaa

SEQ ID NO: 6776 - DNA, 172 bp, Zea mays
gcgcaagataaacaaatggatggccgagccagcactggcactacgtgcgtgctccttgtacacgtgggaccgcgcaccatgggtggagtctggagtggagtttgtgcttccacgtacgctcggtatatgtgtatagatatttagtcggttgtccgtgcgttgcaacggctta

SEQ ID NO: 6777 - DNA, 156 bp, Zea mays
ttttataagcctaaggccttgttcgtttccatcggattgctttttttttcgttccagctaatcaaagtttatataaattagagaagcaatccagttaggaatcgttccgacccaccaatccagcagaaacgaacaaggcctaagcattataaaaaa

SEQ ID NO: 6778 - DNA, 80 bp, Zea mays
agacacgccgatcaggctgcgttggtaatcagctgagtaatgacattagctgaatattgactgcgccctggcaacacgac

SEQ ID NO: 6779 - DNA, 70 bp, Zea mays
ttgttcctacactcacactgttgttgatcaaatcattttttctcgaacacgcaggagagttgtgtatcat

SEQ ID NO: 6780 - DNA, 72 bp, Zea mays
atccccgtcgagcaagtctgcgaggcgtggcgaccgaccaagtccccgtcgagcaaatctgcgagaaggggc

SEQ ID NO: 6781 - DNA, 187 bp, Zea mays
gacgtcagtgctcccatgcgtaaaatgcattcaacccatccgttcaatattcaacggtgtaccgggttttttaatgaacaacactaacgtgaggagcgtgagaagacttatttacaaaaatgttataataccgttggatacaaaacggatcggctggatgcattttgcgcatgggagcacctgttat

SEQ ID NO: 6782 - DNA, 78 bp, Zea mays
catcagctgacgccgaatgccgtggtggccctgtcgaagtatgtctgggcgacgacttcgtacggcggacagccatcg

SEQ ID NO: 6783 - DNA, 75 bp, Zea mays
taggtatatgcccgtgcgttgcaacggagacatataatacataagtccccgttgcaacgcatgggcactcaccta

SEQ ID NO: 6784 - DNA, 146 bp, Zea mays
cttcgcacgacctcgtgactcgatttgcggcgcagattatatttttgccaatagaaaccttgacggatcaccttggcagcaagggccttgggcctcgagtgagagccgcaagtgccgctgtggacttcgcgcaggatctggaggcc

SEQ ID NO: 6785 - DNA, 93 bp, Zea mays
cggcccggcccaagcccgaaaaggcccgtattgtttgaatttcgggccggcccgacccgtttgaatttcgggccgtgtcgggccggcccatgg

SEQ ID NO: 6786 - DNA, 202 bp, Zea mays
tctattactactacggccctgtttggcacagcttattttcagcttcttcacaaatttaagcagaagttctgccaaacagctagcttctgcagcagcttatcagttcagctgcttctcagaatacactaaaagcagccaacaagcagaagctgctttttcaacaagcatcagctgtgccaaacagggcctacgtgtgagtctt

SEQ ID NO: 6787 - DNA, 118 bp, Zea mays
ttgaattgtctctcgagacttcggatggacgcgaggtattgcataagtgcggggtcctttgttgcatagtctttctcgacttggctggcgactaccttggaagtcttgttctgacaat

SEQ ID NO: 6788 - DNA, 115 bp, Zea mays
atgtgaatgactccgcgatacggctgatcagcaaagtcttcctgttttggtgcttgggggtgatttgagtggtggatgtttggctgatgcgggtgtggaggcggaagtgggggtg

SEQ ID NO: 6789 - DNA, 222 bp, Zea mays
cagtggagtagggtgttacgctccggcggcccgaaccactctaaatccttgtgtgttcttgtgttcttcccgttttcccgactaacaagcaaaacacttaggcccctcctcatcttaggatttagggcgtttgcactccgccacccggccagggatttgctctccgacaaggcggtatcaaagctgttaggttggctgcaggatgtaacccttagtccgatc

SEQ ID NO: 6790 - DNA, 165 bp, Zea mays
aaatgtcattggtttgaccctcaagtgacgagacggacacattctaatcttgggatagtcgaaattcgataggatttcaccttagcaggagacgatgtctatatcgtggcccaacaggccacacaagtgtattatctcccatatgcgtgtcaaacgaaagaacat

SEQ ID NO: 6791 - DNA, 98 bp, Zea mays
cttcatcataggcgccttcaggtttctacgtggaacttttctagatttgcatgaacctccgcaacctagggcctgattggttgccgtatctagcagca

SEQ ID NO: 6792 - DNA, 77 bp, Zea mays
ggtttttgaaatgtgaccgttgatggacgtgttactgttggactgcatgtttctcgaggtgtcgcgtcgcgcctata

SEQ ID NO: 6793 - DNA, 142 bp, Zea mays
catatatgtgctacctagttacaaaggaagaaaactgaattccccagctttgcttttatgggaagaacttacagaggtgctctatgttctagggattgggcagaggctctccttcagttgtggcaaggcggacacacccggg

SEQ ID NO: 6794 - DNA, 84 bp, Zea mays
agtgtcatgaccatagcactcggcaaaggatgcacaactagactctgggaaactttctttgccgcatgctatagtcaatgtact

SEQ ID NO: 6795 - DNA, 95 bp, Zea mays
gggcggttgcaaagcgtagggttagtgcggaggagggggctcggcttcgagtgagtagggctgatcggcaggaactgttgtctttgccggccgcc

SEQ ID NO: 6796 - DNA, 79 bp, Zea mays
tttggtttggtgggcgcagtcttcgccgtgaaaaaggcagtagaaccggcgcggcggctgctgcgctcgccctcgaccc

SEQ ID NO: 6797 - DNA, 215 bp, Zea mays
atactgaaggctgcgcagaagtcaaacaaccacacagaaattagctctgtagatctcccgaagaggctccttcacatcagcacgtgaaaatacttttgtttcgtgtttatacctcgctaaggctgattgttactagtataaatacccccttaagtatgatgtaaggcagctttggataatctaaaagttgtgcggctttgttcagctgtgtgcta

SEQ ID NO: 6798 - DNA, 102 bp, Zea mays
ttgagtgttttttggcactaggcaaaaaaagtttctttgtcgagtgttttgttcccgacattaagcaaagagcttctttgccgagtgtcaaaaaacacttga

SEQ ID NO: 6799 - DNA, 136 bp, Zea mays
ccagtaaaaatctttgtgggatcaccttagcagctagggcccttggccctgcgtgtgagccgcacgtgccactgtggacttcgcgtaggatctggatgccttcggtttcggtgacgcacttaagcattggctgact

SEQ ID NO: 6800 - DNA, 137 bp, Zea mays
ttctccctcttagggctagtttgggagccccatttttccaagagatttctattttcccaagggaaattagttcattttccctttgaaaataggaatcccttgggaaaatggagttgccaaactagctgaaagggaaa

SEQ ID NO: 6801 - DNA, 74 bp, Zea mays
acacaaatgaaaaacgtctatggatgcagatataagctacgagcataaatgcatgcatatgcgtagccgactat

SEQ ID NO: 6802 - DNA, 80 bp, Zea mays
agtgtcagacgtggaacagtcgacaaagatttgtttaaaaccctaaatccagtctttgccgagtgcccattgacaagcac

SEQ ID NO: 6803 - DNA, 226 bp, Zea mays
tcacggaagctttctttgccgagtgccaccaagcgaggaactcggacactcagcaaaggctctatcatcgtcacaatgtcttttctttgtcgtgtaccagttggcactcggtaaagacgttactgagtgcctgatagaaagtactcggcaaagagaccgttgccgacgtttggttcactaagggctatttgctgccttttggacttgacaaagaaaccgtctccag

SEQ ID NO: 6804 - DNA, 152 bp, Zea mays
caaaatattcatggcttgttggctcgctcgatttatggtcagctcgactcgactcggattgtctcgtttgatttttcaccagctaagctaacgttctaatttggtttattaacgagccagctcgcgagctaaacgagctatcacatttcagc

SEQ ID NO: 6805 - DNA, 223 bp, Zea mays
ttaagggataactaggtattaacaggtagcacaaactatctagatttcagacatcaccacatcggcaagcactcatccatgaaccatgatccattcatctatccatcagaaaagaaataagtacttcgagacggatagaagaaatggagaaatggagtttgctcaccttccttggtcaccatctgagtttgttggcgcctgagaatccatggtcgtcaccgtc

SEQ ID NO: 6806 - DNA, 146 bp, Zea mays
cctcctcagcgctgatttggtgaccagaaaaataaaagagatccatgtgagaggaatcctcttcctaatcaaaattgaataggaaggggattcctcgtctatggattctcttcatttccttggtcatcaaaccagtcctcaatctt

SEQ ID NO: 6807 - DNA, 107 bp, Zea mays
accggaatccggacctttgccgagtgccagtctctttgtcgagtgttccgacagacactcggcaaaggtaaatcctgtgacactcggcaaagacgccgtctccgtca

SEQ ID NO: 6808 - DNA, 68 bp, Zea mays
tttggacgatccattgcgacggcgcatggtgccatgcgggggcaggtgccgctgcagtcatcacctca

SEQ ID NO: 6809 - DNA, 135 bp, Zea mays
ggcactcggcaaagtctttgctgagtgctcgataaaaagtactcgtcaaagaagtcgttgtcgatgtactattcgtcgagctttctgtgccgagtgtgacgctcggcaaagactttgccgagtgctttagtcact

SEQ ID NO: 6810 - DNA, 94 bp, Zea mays
gcttgttaatcgtgctaaacgggccgtgcccttatcgtgccgggcctggccatgccagtgccgggtcgggccacccgtttggccatctataggt

SEQ ID NO: 6811 - DNA, 169 bp, Zea mays
caatccttcttccaacggagcagctaaatggaccaggcaaaatggaaggcagcggagagaaaagccatattatctggtactgtgatcgacaactaaattcttcattcttgactgaccactacgctccggcatctactccattgcagctgaacgtatggatgactgtgct

SEQ ID NO: 6812 - DNA, 185 bp, Zea mays
ttatataaaaaaccgcttgtgatgtgtggctaacacaagcggctaggataagaaaccgcctgtgatgtgtgtctatcacaggcggttcctttgaactggaccgcctgtaatgtgtgtctttcacaggcggtttttgattgaccgcctgtgatgttgtataacatcacaagcggttcctggaacat

SEQ ID NO: 6813 - DNA, 257 bp, Zea mays
ctcccgcaccaccaaaacgaccggatgtgagcgttttcccggacatgagcgccctgcttcttctcctcccctctacacttatatgactctccaactaaacaaagaacgaaacggctccgttgtattttactcttcaaccaaatagaacagagtcgctccaattttttgtttggttgaattttggttggagagtcatataagtgtagagggtagaagagtgaggagagcgatcgcatcaggtcgttttttagagcgaa

SEQ ID NO: 6814 - DNA, 93 bp, Zea mays
cctaaaatccaacctgttgataattatggatatgtaatattacatttgtgttgtataacaaatccgttgtagtctagctagttaggatattcg

SEQ ID NO: 6815 - DNA, 253 bp, Zea mays
gctcgcagtcgctacgttgccgagtatctggccgcatcttcgtggttgtgttctttcgcgggttttagttgttggtcaagcacgcccctgtttcctttgtcttgtcatcgtcgttcggtcacttgcctcgatgccggttcctgcgtgtcgtctccaacttatgttcacgccgacaaaagcctcccaagaagatgtggagaagcaatcccctagtcgatagcccaagtgctcggcgaaaggctagaacaagaat

SEQ ID NO: 6816 - DNA, 120 bp, Zea mays
aacatacccaggccttgcttaggcaggggtccggtgccgacatgtgtccaggcccagcctggtgcggacctgtccacataacgctactgctccccgctcaggcggaggcccgatgctacc

SEQ ID NO: 6817 - DNA, 123 bp, Zea mays
taattgagtgcccgtgcgttgcaacgagaacatatatcataataacttatgtacaaaaatgggttatactgttataagttatcgtgatatatatttccgttgcaacgcacgagcactcaccta

SEQ ID NO: 6818 - DNA, 202 bp, Zea mays
attgggtattctgggccaagcccattccagcccggcccatttggcccatgagagaaccctaaccctagtgccccttctataaatatgaacccctctccccttgcaaattttccaatttgcaaggggaggcacttctatttatagaggagtcctatggttagggttccaaatgggctgggttgggctagcccaaaacacgtaa

SEQ ID NO: 6819 - DNA, 204 bp, Zea mays
ttaatactagctagatgcccgtgcgttgcaactggaatatataatatcagtatactacgataacttatatacaaaatctgtgttatattgttatgagaaaatgtttcataatcaatttgtgatcctagccatacataaattttgttattttaatctagttatttcaccactatattgcaaccatcagtattatgcagacttcga

SEQ ID NO: 6820 - DNA, 110 bp, Zea mays
aaacaagcaaaactccattatgatgcacaatttagtggcgtcctttgttagtcatttatttgtttactaggtatatacccgtgcgttgctacggagttaacattgttata

SEQ ID NO: 6821 - DNA, 259 bp, Zea mays
gttcaatgtagcgagcgtagttcagtggtaaaacatctccttgccaaggagaagatacgggttcgattcccgtcgctcgccagcttaatttagtaaggtgctatgataaaaaattcagtctagttgactacttaactacttaatattatagtttatatttaatattatagtttatattatagtaaattatatatatttatttttaatatagtaaattattatagtaagtgactacttaactacttcgattaaatgacta

SEQ ID NO: 6822 - DNA, 79 bp, Zea mays
agaggccagagtccccaaccctatatcatgtgtctcgtgtgttcctctgccgtgcttatgggaagggagacggatcttg

SEQ ID NO: 6823 - DNA, 213 bp, Zea mays
aaccaaggaaccgaaccgaaccgaagaaccgaatgcccaggcctgcaaacaacaacaagtgcacaatgactataatttcatagataatacatggatgattagaggttcaacataagtcaataacacaacatccgaagttacaaacacatgtaacaaattgaatctaatacttttgggtttttcggttctttcggttctttcggttctttggag

SEQ ID NO: 6824 - DNA, 229 bp, Zea mays
gttctatctagtttgtgtgtttggtacaaaggaactagaacggaatgactccaattagggaatatctcctcagatccggaaccattccgctctaaaaaatcaaccggacggagccgctccgttccaatcccgctcgcacagtcacgctccattccgtttactctgcaaccaaacaaaaaacagagccgctccgttccagattaccaaacacagaacatagcggcttcgt

SEQ ID NO: 6825 - DNA, 212 bp, Zea mays
gaacagaaataagggtgcgtttggttgtggaacagtcaggacaggagcgtcccctggcgtcctctctcgtccctccaattttgagggataactgagacaacactgggatagtcctgtcccaacccttgacactgaaccaaacaaccttattgagggatcatctcatcctgtcccgtcctgtcactgcaaccaaacacatcctaatagtattg

SEQ ID NO: 6826 - DNA, 177 bp, Zea mays
gacggctttaagccgtcggagataactcgtcggaaatagtgctatgtccgacggcagacgtcggacataagttatctccgacggctgcctatgcccgtcggagataacaaatcccaaccgttttaccggtcggaatgtgggacccactgaattaagtccgacggctcccgctaggcc

SEQ ID NO: 6827 - DNA, 82 bp, Zea mays
gacgatgggccgacgagaggaaggaggacgcactgacgaggacccacaaaccggagccccgcctcactctgtagcccttagt

SEQ ID NO: 6828 - DNA, 175 bp, Zea mays
ggtcctcgccgtttggcgttgtgagcttgtaagcgctgggggaagctttcgtcttgactataaaggggccctcccacttgggctccagcttgcccttagactccgtccgagctgttcggacgagtacgagatccccctcgctgaactccctcgggatgactgtgtggtcgcgcca

SEQ ID NO: 6829 - DNA, 125 bp, Zea mays
catggggtgcttctttgccgagtgccacggtggcaattgacaaagtctccaatgtcgtcacctgacattgtgacgacgacttttctttatcgagagccatgtggcacacggcaaactctttgtca

SEQ ID NO: 6830 - DNA, 94 bp, Zea mays
caagtgagccgctaacttcctagaggcgaccataggaagttagcacgtgcagctaacttcttaagtcctcaataggaagttagtatttagttga

SEQ ID NO: 6831 - DNA, 180 bp, Zea mays
cttgtctgttcgccgcgccgggccgccacgatggggtgcccacgcaggagctgcacgcctgcgccggagccgcgccggggtcgtgcccgtgccagggtcgattcgggcgagaggcgaggtggggagaggaaaatggtgagctccttgcgacgtggtcgcccgagggtgaggagggacggt

SEQ ID NO: 6832 - DNA, 86 bp, Zea mays
ggacccaatactcggcgccataggatgtggcgccggggtaacacatctcggcgccacagcctatggcgccgagctgtgacgtggca

SEQ ID NO: 6833 - DNA, 108 bp, Zea mays
gtgcccgtcttacggcttctgaggccttctgtggcagaaccacccgagtgagagacccacatgcacctgtcctgtctcaaagacctcagacagctatgcatggcacca

SEQ ID NO: 6834 - DNA, 203 bp, Zea mays
ggctataggtgtacattcgggccgcccggtccggcccggcccaagcccaaaaaggcccgtaatgtttgaatttcggtttgtttccgacccgtttgaatttcgggccgtgccgggccggcccatgggcctagcccacggcccgacccgtaattgcttaaacgtgccgggctcatttcgggcggcccgaaattataaaagcccga

SEQ ID NO: 6835 - DNA, 94 bp, Zea mays
ggcaaagggttctttgccgaatactttttttcggacactcggcaaagactttgctgagtatcaaaaagcactcggcaaagaaaagccctcggca

SEQ ID NO: 6836 - DNA, 253 bp, Zea mays
cccagccaaaagtcatcagtactcaccatgttgcgcgcgttcgatgactactatatcatggactgtagcgtcatctcggcgccggaggtgacgcagaggaggaccgacagcaatgatcagttcgtcatccttcccaccatcggggtagctttttgtgctggtctgcatttaattctcttcgcaaacacacacacttgcttttttgtttgagcaagcgtgtatggtggtgtgtgcctgatgactgcgatgtatg

SEQ ID NO: 6837 - DNA, 219 bp, Zea mays
atattttcttgtgtcctccgccactgatccacgctgtgatcgggggcacccaaccctatatggttggtggccccctatgacactgcactataagtaaagggtgggggccggttggtctagatgacatagttcgctagagtcatattccccaccgacaaaccctagcaccgatctgagagggtgcacaaccagtgacgggaagacactgtcgttcttcgc

SEQ ID NO: 6838 - DNA, 179 bp, Zea mays
ccggtggcaagatggacggccaagtcactctagcaaccatgtcctccagagaacctgtaaaattatgccacaagcaaggtgagtatactatactcagctagactacccggtgtgaggagtctactcctctacctctagacatgctgctgttgctgtgggttggttgccaaacactagct

SEQ ID NO: 6839 - DNA, 72 bp, Zea mays
gctgacctcgcactcgacaaagaaggctccagtgggccctttggcagtccctttgccgagtgcgctgggagg

SEQ ID NO: 6840 - DNA, 95 bp, Zea mays
ttcctttttttgcgctaacagacgtggagcaggtggcgcacccgatagtctggttgggcgcgctggttgaaccagtttgcaggcgaagtcggcct

SEQ ID NO: 6841 - DNA, 105 bp, Zea mays
tacgtccgggggctagaaaccatcggacataagccgataccgtcggacatagcttaagttcgacggcttaaggcttatgtccgacggctttggccgtcggaagtt

SEQ ID NO: 6842 - DNA, 127 bp, Zea mays
gtacaagtgcggccactgcacgacggcagtcggggtcagtggattttttgtatgccaaggcggtgaggcctggacgcgaacggggaatcgatggggacgattgtcatgtgtggggtctgtgtatctt

SEQ ID NO: 6843 - DNA, 161 bp, Zea mays
cggcaaagtagtctttgccgagtgcttcgttgtgccgagtgtcctgcactcggtaaacaagctctttaccgaaggcaggactttgtcgagtgcggcgctcggtaaagtcttctttgtcgagagcccgataaaaagcactcggcaaagccaccggcactcag

SEQ ID NO: 6844 - DNA, 199 bp, Zea mays
caacaagaccctctaaagggtcctgtaccctaaatttagaggacggtcagcaacgtcttctaaacggtcctctaaatttagagaatccagcagcgtcctctaaatttagaggaccgtttagaggacgctgctggagggcgtagaggaccattcgatcctctatatttagggtacagaaccctttagggtcccttgttgg

SEQ ID NO: 6845 - DNA, 95 bp, Zea mays
cggtcagcaacgtcttctaaacggtcctctaaatttagagaatccagcagcgtcctctaaatttagaggaccgtttagaggacgctgctggaggg

SEQ ID NO: 6846 - DNA, 207 bp, Zea mays
tccggtatccgttccccgttttccaagccagaatctccgtatatttgcacttccgcaatgccagttttatggacaagctggggcccccggcgaagcagccggcgagcggcatgcagtccttgtgcgggagaggagaagagaaacccgtggaaaagaggagtgcaggtacacggcgtgtgttttgcggagacggatgcggaggctgct

SEQ ID NO: 6847 - DNA, 172 bp, Zea mays
gatcaccgagcaggggagcaagccagattgcctgagttgaagtggtggaggccgctatgtattcggcctcgcagctggacatggccaccacctgttgcttgatcgattgccaactgatggagcttttttccgagtaagaagaggatcccgcttgtgctcttgctggtgtcga

SEQ ID NO: 6848 - DNA, 132 bp, Zea mays
actggcactcggcaaagtctttgctgagtgcccgataaaaagtacttggcaaagaagtcgttgccgatgtactattcgtcgagctttctttgccgagtgtcacactcggcaaagactttgctgagtgttttt

SEQ ID NO: 6849 - DNA, 97 bp, Zea mays
tgtcacaaataaaacactcggcaaagagtttctttgccgagtgtcaaaaataaaacactcgacaaagagctcttggtcgagtgctttttttccaaca

SEQ ID NO: 6850 - DNA, 149 bp, Zea mays
atagtgaaggctgcgcagaagtcaaacagccacacggaattcagctctgcagatctcccgaagaggcccctacacattagcaaagttaaaatactttcttttcgtgtttatacgtctctaaggctggttgtttctagtataaatacgcc

SEQ ID NO: 6851 - DNA, 104 bp, Zea mays
tgcttgggacgccataggctatggcgccgaagtacgtgctgcgctggcacaattcggacgacgtggcaccaaactcggcgccaagatctatgacgccaagctcg

SEQ ID NO: 6852 - DNA, 174 bp, Zea mays
atagggctctacgcaggaaaaactgctccaacagtgcctcatttcataaaatttggtcaaaaaactataggacaccctctaaagtgactcaaatatactacaccatagtgggctgccctataatctagatttgatggtttactgttggagcggggtgttttgttggtgccctaa

SEQ ID NO: 6853 - DNA, 87 bp, Zea mays
gccacgtcaaagctcggcgccatagcctatagcgccgagatgtgttacctagataccatagcctatggcgccgagctaagggtcaaa

SEQ ID NO: 6854 - DNA, 88 bp, Zea mays
tttgacccttagctcggcgccataggctatggtatctaggtaacacatctcggcgctataggctatggcgccgagctttgacgtggcg

SEQ ID NO: 6855 - DNA, 77 bp, Zea mays
aggggaaacgagctcttctcggcgagcagcgcggtcgttttataagcctccctagctcggcgccaagatctgtggcg

SEQ ID NO: 6856 - DNA, 71 bp, Zea mays
gtgtctgaagcactcgtcaaagcctggaaaacactcagcgaaggctttgccgagtgtgacaaatagacaga

SEQ ID NO: 6857 - DNA, 218 bp, Zea mays
atgaagtattccttcctgctaacatggtactactttcatccttatttaagtgtttggttgaagagccaagtagaacagagccgttccatccctgattctaggaacggagccgctctgttctgtgtttggtaatttggaacggagcggctctgttttttgtttggttgcagagtgaacggaatggagcgtgactgtgagagcgggatgggaacggagcg

SEQ ID NO: 6858 - DNA, 86 bp, Zea mays
tgtccgccaaaccacattcgtttctgccctccaccttgaagtgtacattagatgagagatcagatcagaatagtggcctgtaggac

SEQ ID NO: 6859 - DNA, 130 bp, Zea mays
tcgatgaactgtacatcggcaacgtcctctttgtcgagtgcattatgtcgagcaatcagcaaagaaaagtcgctgtgacggtgataagtgacggtgacgaaggctttgccgagtgtattcactgacactc

SEQ ID NO: 6860 - DNA, 86 bp, Zea mays
tagcaggtatctcggtgccatagcctatggtgccgagctatgttacctcggcgccataggctatgacgccgagcaaagggtccaaa

SEQ ID NO: 6861 - DNA, 109 bp, Zea mays
gtcaacacatgtagagatggcaatggggatttccccgtcgggggttatcttcccatacccgtccctgcggggtaagaaaatccccgtcgccgtctctatcccggctttc

SEQ ID NO: 6862 - DNA, 237 bp, Zea mays
gtttgggaacattagcgggctggtgctggcacgacccgtttttttgagcgtgcctagtgggctggcccggcacgaaaagtggcccagagggtcgtgcttgggccaacggccaggcacgtgggctctctaggcacggcccgttcagcccgtatacccgggccggcccgttggctgatgggctgtgcttccccgggcccatgccgggtcgtgccgggccggcccgttggccatctatag

SEQ ID NO: 6863 - DNA, 73 bp, Zea mays
gtgggacgccatcgctgcgacccgcatcggcgtggacagggtccgtcgagcaacgttgcagcgcctacgccgt

SEQ ID NO: 6864 - DNA, 74 bp, Zea mays
caagaccatagcactcgacaaagaaagcacacctgtgaatcggtaaagctttctttgcgagtgctatggctggg

SEQ ID NO: 6865 - DNA, 100 bp, Zea mays
ctgttgtttggttgctgtgagccaggctctatgcgtgctagctttatgtttggttgactgcacgcagatttgagtccaggctcgcacgatcctcaaagta

SEQ ID NO: 6866 - DNA, 78 bp, Zea mays
tgaaaatattcttgcaggtagaagccatccgttctcgagctaagctaaggataacctctatccacaagatctaagcag

SEQ ID NO: 6867 - DNA, 95 bp, Zea mays
gtttacttccgacggccccgtcggaaacgcggatacttccgactgggtatctcctacggcgttacttccgacgggacccgtcttaagccgtcaga

SEQ ID NO: 6868 - DNA, 76 bp, Zea mays
cacgctgatcaggctgcgttggtaatcagctgagttatggcattagctgaatattggctgcgccctgacaacacga

SEQ ID NO: 6869 - DNA, 82 bp, Zea mays
tgtccgacggctagactgaccatcgtcggacataaaccttatctctgacggctgtcagcatagtcatcgtacataacacatt

SEQ ID NO: 6870 - DNA, 69 bp, Zea mays
aaattgaaacgagccgagtcgagtcgagccgagctggccacgagtcgagcgagctcaccacgagtattt

SEQ ID NO: 6871 - DNA, 149 bp, Zea mays
agatatccaatgggccgtgcccgtccggcggtatgtggcaccatacgtttttagcccgtcatgaacatggcacggctcgttattcaggccgggtttaggccgctgccgtggcacgtcgtgccggtccgagcacgatccgattatttttt

SEQ ID NO: 6872 - DNA, 120 bp, Zea mays
atgtttggtttgatgactaagttgtcacactttgtctaacttttctgtctaaggttagttcttcaattcggacgactaaccttagtcaaagtgtgacacagttagccacgaatcaaacat

SEQ ID NO: 6873 - DNA, 205 bp, Zea mays
ctgtcgtcggataaagggcatggtggactccctttatgatcttggcaagcccatccccgaccggaccctcatcctaaaccttctttgttgtaacaccccgtccaatccctggacaggcggtacttactcctagcagctatctaggatcatatattgtccccacagaccaacatgagtcttttgtgcgcactttgtcctcacacat

SEQ ID NO: 6874 - DNA, 86 bp, Zea mays
ctaatgcttgcaagagccaagaacgtcgtgccgtgctttagcaatagcctcagcccgacacgattttttttattttacaaaaaaaa

SEQ ID NO: 6875 - DNA, 68 bp, Zea mays
cttcgttttgcgcacttgttgtgctaagtccggctgcaccttttaagcgacttctgcgcggattgagt

SEQ ID NO: 6876 - DNA, 128 bp, Zea mays
cagctagtttgagagccacaaaaccggagagaattggagggattaaaattccctccttattcaattttgaataaaaaggtgattttagtccttctaatctccttcggtttttggactcccaaaccagc

SEQ ID NO: 6877 - DNA, 165 bp, Zea mays
ccctgttcgatctcgttgtcaagcttcgcctcagccttagctcgttggtcacactcgccagatattcgcttgaggacttcagctgaaggtcgtcgtcgatccgtgcgtcatcaagaaatcccaagaatcgggtgaagacgaagctagcagcgcgatattccccaa

SEQ ID NO: 6878 - DNA, 78 bp, Zea mays
agtgtgcgattggcactcggcaaagaaactttaccagttcccaggtggtctttctttatcgagtgctatggtaatcgc

SEQ ID NO: 6879 - DNA, 243 bp, Zea mays
aggcgcccccacctccaacatcgatactcgacggcaagcgggggaggaaggcaggcgcggctagggttggcagcgtggtgtcgtcagcgacgcccgtgtatggctcgcgaccctgagggtccaaggtgacgctctctggctagttcgcgcatcgtcgtcctccttctcctcacagcccagggttgaagcagacggctgggggcgcgacggtcgcagatccgaagacggggtgtgggggaagaa

SEQ ID NO: 6880 - DNA, 96 bp, Zea mays
tttgcttgcacgcttgcaaagaatgactgcttgcataacagtcgttgctctaaaactcttatgcaagcggtccttctatgcaaacgtgcaagcaaa

SEQ ID NO: 6881 - DNA, 191 bp, Zea mays
cgtcgagcccgtcgaacctcattcttccctgcccgacctggtcgaaccccgaatcccagacgttaggcaaaaataagcaaggtcagtgtgcattgcttatccagtgctcggtcgaagacttcaatcgaaggtcgtcgtcgttcgtgcatccacaagaaatcccaagaatcaggtgaagacaaagctaggag

SEQ ID NO: 6882 - DNA, 194 bp, Zea mays
caaaaaatttgcgaaggttgtcgacgttccaggagtgctctaggtcctcaccgtttggcgttgtgagcctgtaagcactgggggaagcttttgacttgactatgagggggccctccgcgcctgggctccaacttgcacatggactccgtccgagctgttcggaagagatcgttgtcaacctcgctgaactccct

SEQ ID NO: 6883 - DNA, 107 bp, Zea mays
cagtccccccccccccccccccatccaacctcagacggagtctgggagactaccacgttcgtagctagagaaaatgaaaggggtcgggggggggggggctcgtttgc

SEQ ID NO: 6884 - DNA, 88 bp, Zea mays
tgccggccgccgactcgccgttgtccagtcgccaaccacgcgtccacgcggtgaccgaagactggagcatgggagcaggcgaggcgtg

SEQ ID NO: 6885 - DNA, 125 bp, Zea mays
cggctgcaatgcctacgcctaccgcctcgcctcgcctagggatggcaacgggcacattttatccgcgtgcccgcaggtaaaaaccctatagggtgcgggtttgggtgtgagtttatacccgtggg

SEQ ID NO: 6886 - DNA, 148 bp, Zea mays
gacacattaagggcctgtttggtttgtggcgaaaagaggcacactttgtctaaggttagtcattcgaatcgaaaaaataaccttaggcagaaaagttaggcaaagtgtggcaacttaggtagtgaaccaaacatgccttaaatggggc

SEQ ID NO: 6887 - DNA, 217 bp, Zea mays
tttcgggctcgcacggcggcgtgacgaagcgagttgacaaaacaagtgcaagaactaacggcatgacaaggcgagttgacaaagcactgcaagaactaatataagactatccgcaaccgttccctctaaattttcccccctaaatattactatgcagccacgtcagcaagattctctctcctatattcactcgtcccgcaaccgttccccctaaatt

SEQ ID NO: 6888 - DNA, 112 bp, Zea mays
agcggacggatgggccaggagccgcgggaggaagaaaaggcctgtacgagtaggaccatatcgccgtcgtctcggcgaaacaccgctgcggctataggtcggtccacctcat

SEQ ID NO: 6889 - DNA, 129 bp, Zea mays
gttcatcaccctaaacactgtgctatgagtccacgagtaattgttagtagataaaaaattgatagttggtatagaaaatgatattttatagtggtagtggggtatagaggagtatttagggggaaccgc

SEQ ID NO: 6890 - DNA, 101 bp, Zea mays
catgtcccctagctcggcgccatagatcttggcgccgggctagaggctgacgtgtcccctagctcggcgccacagatcttggtgccgagctacgacggcct

SEQ ID NO: 6891 - DNA, 83 bp, Zea mays
tagctcggcgccatagatcttggcgccgggctagaggctgacgtgtcccctagctcggcgccacagatcttggtgccgagcta

SEQ ID NO: 6892 - DNA, 106 bp, Zea mays
cggcaaagtgttctttgccgagtgccagctggatgcactcggcaaagaatcttttacaatcctttgccgagtgtcgcacgctggcactcggcaaagcatgctttgc

SEQ ID NO: 6893 - DNA, 104 bp, Zea mays
gcaaagcatgctttgccgagtgccagcgtgcgacactcggcaaaggattgtaaaagattctttgccgagtgcatccagctggcactcggcaaagaacactttgc

SEQ ID NO: 6894 - DNA, 154 bp, Zea mays
atcacgaccactgctctgaccggcggcgcaccgaagggccccttcgtctgcatcctcttctgccacttcaaaaggcggatacgcagagtaatagtgagagcacatctcagaaacagggagtccttcgtggccttcgacagtagcctcagcaacg

SEQ ID NO: 6895 - DNA, 66 bp, Zea mays
catagggcggctagtgcgcggtcgagcgcttgagtacgcgatcgaacacgtggaagtgtgattctg

SEQ ID NO: 6896 - DNA, 77 bp, Zea mays
cgacgtggaaccgagctcggcgccacagatcttggctcggcgccacagatcttggcgccgagctcggttgtgttatt

SEQ ID NO: 6897 - DNA, 170 bp, Zea mays
cactcgagccgcagacgccaagggccagacagagatgcagatcgctgatcgtctatcgcagcacgttgtagtcgcagcgacgaaggacgaacggcggaagcggaacagacgaagagtcatcgtcgtatttatgtattctactggtttattgggctgcaaatgtgtatcta

SEQ ID NO: 6898 - DNA, 165 bp, Zea mays
aggcgaggaccattattatcgtgcggaggtataaatggctaaatgagtcgtgtctggcgggccgactcagggcacgacctatttaatagtgtctgggccagcctggaacgagtgttgtgtcgtgcttgagccgtagcctcggcccatagtgctgacccggcctgg

SEQ ID NO: 6899 - DNA, 156 bp, Zea mays
ccagctgcaaaccacgatgtttgcagctcctcacaaaaaagaggatagaccccactcgcagcagcaataacacaactaaaatgttacctagtggacctgcaggtgggatctattctcttttttgtgagggctgtaaacatcgtggtttgcagctgg

SEQ ID NO: 6900 - DNA, 222 bp, Zea mays
tatgaaagtgtggaatgaagtgtggttttataacatatatgagccttttcgtgcctctatatgggccattccgtgcctgccttaaacggaccgtcctcgtgcccacacataggtcgtgacctcggctcaaacccgacccgatataacaggccgtgtcggcccgacactaaattatttcgggtcgtgccgtgctggaccgtgctttttttccgtgcttcgggc

SEQ ID NO: 6901 - DNA, 180 bp, Zea mays
ggtgtatgcccgtgcgttgctacggagtcagcatgtactagtaagacgcaatgagatgtagaagcactacgataaaatacattgatgtgcaaaaacaattattgttattctatacttttgttagttacatacctaaaaaatatagtacaatgactacgttgcaatgacacacaaattcga

SEQ ID NO: 6902 - DNA, 85 bp, Zea mays
cagcatgtacctcggcgccatagcttatgatgccgagatgtgttacctcagcgccatagtctatggcgccgagcaaatggtccaa

SEQ ID NO: 6903 - DNA, 88 bp, Zea mays
aggaaaaaccgggctaacacggcacgttagacgggctgggccgtgctccggcttgtggcccaacgggccgagtagcccggcacgcctt

SEQ ID NO: 6904 - DNA, 76 bp, Zea mays
gacaaagagcttctttgccgagtgccaaaaaaagcactcggcaaaacatttggcactcggcaaagagccgaattct

SEQ ID NO: 6905 - DNA, 75 bp, Zea mays
gccacgtcacagcttggcgccataggctgtggcgccgagctgccacaggctatggcgccgagctaagggtccaaa

SEQ ID NO: 6906 - DNA, 181 bp, Zea mays
taggtgtcatcgccgaactgtatctgcgtctgcaacagagtgttgaggcggagagcaaagtcatcaacgtcctcacctggcttgaaggccaggttctaccactccttgcgaagtgcctgcagtgtggtcttgcgggcacggtcgctgccgatgcgggtcgcagcgatggcgtcccaggctt

SEQ ID NO: 6907 - DNA, 74 bp, Zea mays
ccgccttggcgtacaatgcctcactgaccccgactgccgtcgtgcagtgaccgcacttatacccaccataaccg

SEQ ID NO: 6908 - DNA, 230 bp, Zea mays
ctcaccagagagcaccgccgcctcacgccaggtcgcggaccgtccggctctatgccgcggaccgtccgcgcctgaccagagggcaccgccgccggttcttcttgagtgattggcgcctccaaaaaggtgtcaacacattgtttttttattgtctagctgatcataagtttgtagcaataatttttttgtttgtccatttacgtggggcagcaggctgctgcgctcttgag

SEQ ID NO: 6909 - DNA, 183 bp, Zea mays
atgggccatttaggccctgtttggaagcggagctttcaaatactacagtatataaaaaccatagtatacagtatgtcgtgacagaaaaccacagttttagcaaaacaggagtaaacctacattatttcttaatacatagccatgtttggtagcacagtttccaaacttgtttaaatttaccat

SEQ ID NO: 6910 - DNA, 243 bp, Zea mays
gagtgcctccttgagcactcggcaaagaagataccaaagggccccgctggaagaccctttgccgagtacaggatggtagacactcagcaaagagataatttctttgccgagtgtattaggtgacaatcgacaaaggtaatttctttgccgagtgtcacctagaacactcggcaaagtcgtcgtcttcggtaccaggcgtcgtgacggtcgcttttctttgccgagtgcccgataaaaagtact

SEQ ID NO: 6911 - DNA, 133 bp, Zea mays
attttacactcggcaaagcctttgtcgagcgttacactcgacaaagaatactcggtaaatattttatcggcaaaggcttttttgccgagtacttttttcggacactcggcaaagactttgccgagtgtagaaa

SEQ ID NO: 6912 - DNA, 241 bp, Zea mays
atttttgaagttttgtggctcgtgtgctaggttataatttttgccctttatgtttgacatgctacttggggcattttgtgtgccattttctcctgtgttacttacaattttgtttcacattttgaaacaattttcctttgtttcactttcctgtggttagtttgacatgcatcaaattcacaagttagcttcacaaaataaaagcaagttagagtcacatgtgttatatcacctcatcttt

SEQ ID NO: 6913 - DNA, 114 bp, Zea mays
gccatctatagcaaagtctttgccgagtgtccgaaaaagtactcggcaaaaatcttttgccgataaaatatttgttgagtgttacactcggcaaagactttgtcgagtgtaaaa

SEQ ID NO: 6914 - DNA, 112 bp, Zea mays
ttacactcgacaaagtctttgccgagtgtaacactcaacaaatattttatcggcaaaagatttttgccgagtactttttcggacactcggcaaagactttgctatagatggc

SEQ ID NO: 6915 - DNA, 224 bp, Zea mays
tcaaatacatcagctgacaccgaatgccgtggtggcgctgtcgaagtatgtctgggcgacgacttcgtacggcgggcagccatcggttgaagtttttgcgaagtattattgcttgcactggcagaagaggatgatcggggacaaagttgctcagtttgggtcatgcacattcacgccgaagaccggcaagactactatgcaagtggtggagttggttccatgcg

SEQ ID NO: 6916 - DNA, 95 bp, Zea mays
gatcatatatgtgtcgatgctcatcccagcgtactcccgttgcaatgcacaggcaagcgtgtatggtggtgtgtgcctgatacctgacgatgtac

SEQ ID NO: 6917 - DNA, 131 bp, Zea mays
cgtgacctgattcgcgcgtagattatagcgggccagtagaactcttgacggatcatcttggcagcgagggcctcaggcctcaagtgagagctacaagttccgctgtggacttcgcgcatgatctggacgtc

SEQ ID NO: 6918 - DNA, 97 bp, Zea mays
gtgtccgtgcgttgcaacggaaacatataatatcacagtaacttatatataaaatatgtgtattatatgtctccgttgcaacacacgaacactcacc

SEQ ID NO: 6919 - DNA, 133 bp, Zea mays
aagcatttggatcgcgatccattaccacccctagccgcgccaggggcaccagcgttagtagaggggaccaaggatgctggccgcacacaccgctggtagatgtgggtgggatgggaagacgattgaggaggta

SEQ ID NO: 6920 - DNA, 80 bp, Zea mays
tttcggcggccagacgccgccgaaaataagccctttgccgccgaaaataagctattttcggcggcgtctgaccgccaaaa

SEQ ID NO: 6921 - DNA, 80 bp, Zea mays
ttttggcggtcagacgccgccgaaaatagcttattttcggcggcaaagggcttattttcggcggcgtctggccgccgaaa

SEQ ID NO: 6922 - DNA, 105 bp, Zea mays
ggtgttctgtttgtgtcatctttgccgagtgctatgacctgtatactcggcaaaacacctctttgtcgagtgttacactcggcaaagtgactcaaatacctcttt

SEQ ID NO: 6923 - DNA, 87 bp, Zea mays
ccacgtcacagctcggcgccatgggctgtggcgccgagctgtgttacctcggcgccacagcctatggcgccgagcatcgagtccaaa

SEQ ID NO: 6924 - DNA, 116 bp, Zea mays
aagctgaagtcctgccaaacaggcagcttctgcagcagcttatcagttcagctgcttctcaaaatgaactaaaagcagccaacaagcagaagctgctttttaccagcttatcagat

SEQ ID NO: 6925 - DNA, 248 bp, Zea mays
agtgcggggtccttcgttgcgtagtctttatcgacttggccggcgactaccttggagtctgttctaatgatgcaggtggtgacaccaagtgcccttagcttgcgagggtcgaggatgacaactttcttattctgctatattgttagtgcatctgtcagaatccaaagcaaagctgagggcatgctgcgtatctgtgcttgactcctgtgggtgaagtaatgactgcagcggcgcctgcccccgcatgg

SEQ ID NO: 6926 - DNA, 145 bp, Zea mays
cgagcgccgtctttcgccgagtgttcgacactcggcaaagacttctttgccgactgtatttttgtgccgagagtcctgctctcggtaaacgtaatcgttgccgaaggactttgtcgagtgcgacactcggtaaagacttttttga

SEQ ID NO: 6927 - DNA, 172 bp, Zea mays
tcaatgactagacaaacttgtgttgtggcttggcttgtttggctagctagctagctcacgagctaatatgagctggctcattacagaaccgagctagaatgctagcttggctcgctacaaaattaaaatgatctgagtctagccgagctactaacgagcttgaaagtctcct

SEQ ID NO: 6928 - DNA, 109 bp, Zea mays
agtaaagggagcttctttgccgagtgtctgcctatctggcagttggcaaagggagcatcattgggcctctttgcccagtgcgctaggaggcacgcggcaaagggagctt

SEQ ID NO: 6929 - DNA, 73 bp, Zea mays
ggaatggcaatttaatccgtggatttggatatccggcggatatccgacccgacggattaggatatgaatatgt

SEQ ID NO: 6930 - DNA, 182 bp, Zea mays
tctgggcgctaaacacgactgagtgcagggtgactgagttcacccctttccgccttctatatggatcagaggccatgacccacagagcaagaaataaaacatgggtccccgcgaacagtttcgtcagctgttcccgacaaggacagagagccagccttgagtctcatcgatggagaccgtgt

SEQ ID NO: 6931 - DNA, 171 bp, Zea mays
tatgcagattctcgcgcctctactgctgacgggagggaaggaagcgaatctggtgatccatggtgacgtaattctcaataaaaacctggtctattattgaaaagagctattcagtatatatatttaatttcaatcctatcctagagcacagtttggcggagggtgcggcca

SEQ ID NO: 6932 - DNA, 91 bp, Zea mays
gaggacacccgcctgcgcacgtggaccgagcgattcagcttataaagggcgctgtcgagccgtacatcgctgtgactggcagatttagacc

SEQ ID NO: 6933 - DNA, 93 bp, Zea mays
ccagaaaagtagtgagaagttgccggccggcacccgtggttttttccccttcactttggaagggtggtagggcgtcttctaacactcccctct

SEQ ID NO: 6934 - DNA, 94 bp, Zea mays
caaaaatgaggatagaccccacccgcagcagcaataacacaactaaaacgttatctggtggacctgcaggtgagatctattctcctttttgtgg

SEQ ID NO: 6935 - DNA, 76 bp, Zea mays
cattcttctgcagtctacgggttccttagagcaagtataataaatttgactaggcgggctctaaacgaaaaggcat

SEQ ID NO: 6936 - DNA, 139 bp, Zea mays
tgccagatatttgacactcggcaaagactgacggccgtcggttgtagacggccgctaacggccctttgccgagagccatgtttgccgagtgcttgacgctcggcaaagcagtctttgccgagtgctttgatgtgccgag

SEQ ID NO: 6937 - DNA, 77 bp, Zea mays
ccttggtcatagcactcgacaaaagaaagcacacttggtaatcgggaaagctgattttacgagtgctatggcccaag

SEQ ID NO: 6938 - DNA, 117 bp, Zea mays
gacttaactaaaatctaacccgcgctccctgaccggctgaaacagtacccgccggcatagtttacggcgggggggcttaccggcggcagtagagctccgggcggggtggtcagtgac

SEQ ID NO: 6939 - DNA, 165 bp, Zea mays
ccgagtgccgaaggctttgccgagtgttttttatcgggctcgttacaaagcagaatttgccgagtaccgccctcggaaacgtcgagaggtgtcggtaaagagttagtttaccgagtgtagaacactcggcacatccaagcactcggcaaagacctgcttttgccg

SEQ ID NO: 6940 - DNA, 100 bp, Zea mays
gtgttttcttttaccaagggttttttgcgtggcactcggtaaagagcttctttgccaagtgcccgacaaaaaacactcggcaaagaacttggcactcggc

SEQ ID NO: 6941 - DNA, 105 bp, Zea mays
gccgccgtcgggccgacccatttatcgggccgggccgggccaaagcacgcgggccgccgtatgtgcccatacccggcccgctaaacgggtcgtgccggcccgggc

SEQ ID NO: 6942 - DNA, 106 bp, Zea mays
atattatatgttcccgttacaatgcacggacacccacctagtaatcaattaagcatcaagggtactaggtaggtgcccgtgcgttgcgacggcatacaaaatatta

SEQ ID NO: 6943 - DNA, 85 bp, Zea mays
atacattaacgactctggtttcggctaatttcggtcgaatcacgcagagaagattaaaatagcgaagccaaactcgtatcgatct

SEQ ID NO: 6944 - DNA, 198 bp, Zea mays
gccgcgggcggtgcggatggaagacgagcagcgacactggaactcctacaagctgtgaacgtgcgcgagaaaatgtgagaagagagaaaagaaggcgtccacacgtcataggaatcttactacttattaagacagcaaagctagtctgcctccctcgttctgtcgttctgccgttaatcgatctggaccgtccgtggc

SEQ ID NO: 6945 - DNA, 218 bp, Zea mays
cggctaccgtgccacggacggtccagatcgattaacggcagaacgacagaacgagggaggcagactagctttgctgtcttaataagtagtaagattcctatgacgtgtggacgccttcttttctctcttctcacattttctcgcgcacgttcacagcttgtaggagttccagtgtcgctgctcgtcttccatccgcaccgcccgcggcaaccgcacga

SEQ ID NO: 6946 - DNA, 137 bp, Zea mays
tttttatccaagttcaaacgaacagttgtttcaatccgagccggattataatcaagattatttctttccatccggaggaaggctaggaaataaggatccgaccgattgaggccttgttcgtttgtgttggattgtac

SEQ ID NO: 6947 - DNA, 80 bp, Zea mays
ggacacgctgatcaggctgcgttggtaatcggctgagttatcgcattagctgaatattggctgcgccctggcaacacgac

SEQ ID NO: 6948 - DNA, 82 bp, Zea mays
gcgctagggccatcctgcagacggcgtgcctgtccagtccattgtcaaacagtgtgcccgtgctgcggggtgcatctgtgtc

SEQ ID NO: 6949 - DNA, 81 bp, Zea mays
ccgagaaaaagtactcggcaaagagggctttgccgatgcactgtgtgccgagccttctttgccgagtgcgacactcgacaa

SEQ ID NO: 6950 - DNA, 75 bp, Zea mays
gagaaaaagtactcggcaaagagggctttgccgatgcactgtgtgccgagccttctttgccgagtgcgacactcg

SEQ ID NO: 6951 - DNA, 197 bp, Zea mays
tgcaggcatgcaagctttgccgagtgccagtcggccatatacagagaaaagcgtccgtcacagcgccggataacgttattgacgtctttgccgagtgtctaccaacctgcactcggcaaagggtccaccagcggggctctttgtcaggttctttgcgagtgctctaggaggcactcgacaaagcttgcctctttgcc

SEQ ID NO: 6952 - DNA, 83 bp, Zea mays
ggaccgtgtcggcctggctcagatgagctagcgggtcgtgtcgtgccggcccacgggccacgagtgaggcccagacacaaccc

SEQ ID NO: 6953 - DNA, 93 bp, Zea mays
ctggcaggcggaccgtcggacgtaagcttatgttcgacggctgtcagacaagccgtcggacataagcttatgtccgacggtcttctaggtggt

SEQ ID NO: 6954 - DNA, 116 bp, Zea mays
tgttcatttgtgccggattagtatgtcggaacgattcatagccggattgcttctctaatttatataaactttgattagctgaaacgattccgggtgcaatccgacgtaaacgaaca

SEQ ID NO: 6955 - DNA, 174 bp, Zea mays
gccacctaggaaaccgtcggacataagctatgtccgacggcttgtcggacagccgtcggacataaacatatatccaacggtccgcctgacagccctcggatattctcccttatatccgacggctgctagcggccgtcgaaacataagcttatgtccgacggcctcctaaacaac

SEQ ID NO: 6956 - DNA, 171 bp, Zea mays
gatgttgagcaccaactatgacgtgtgtgcagatttttgggacttgacgagctgggcagagcagagggacaaccccgcgttgcatcgacggcagcgcgacactagcaagacccgagtccgtacgggccgacagcatggacgagcagacacgacacagaggtgcgagtccgc

SEQ ID NO: 6957 - DNA, 124 bp, Zea mays
ttgactatgcggtggccctcgctgtcattagttatttggagccttcaggggctccggacggctggcgtgtctatgtattgtaagaacacgtcgggagggcaaggactcgccccctggcggcggc

SEQ ID NO: 6958 - DNA, 169 bp, Zea mays
ctagctgagtgtctgtgcgttgcaacgagaatatataataccagtatactacgatttacatacaaaatgtgtgttataccgttatgagaaaaggtttcacaatcaatttgattttgttatattaatctatctatttcaccactacattgcaaccatcagtatcatgcag

SEQ ID NO: 6959 - DNA, 121 bp, Zea mays
gacatatgatatccgtcggcttaggactaacgggaactaaccatataccgacgggaattagtaatccctgtcagtttagagcttatttccttcggttcttagccgacaggaattaagtgga

SEQ ID NO: 6960 - DNA, 175 bp, Zea mays
ttgactgttgaaaaaaaatactcggcaaagaagctctttatgtcaaaaaacattcggcaaaaaagctctttgccaagtgttaaaaaaactcggcaaataaactctttgccgagtgtcaaaaataaaacattcggtaaatagtttctttgccgagtgtttttttatcgagggtttt

SEQ ID NO: 6961 - DNA, 175 bp, Zea mays
tatcggaattcggctttttgccgagtgctaaatgatttgccgcgtgttttttcgggttctcggcaaaaagcttttgtcgagtccaaccaaaaaaccctcgataaaaaaacactcggcaaagaaactatttaccgaatgttttatttttgacactcggcaaagagtttatttgccg

SEQ ID NO: 6962 - DNA, 170 bp, Zea mays
ttacaacatcatcggagtttaacagaagtagtgctcattgttcggattgcagcggaatagaactaacgataaataaacggagggatggggaagcctgtcccatcaatcctcatgctcctcctctgtctatttatggtcccactcgactgtccaacccggtggcatgatgg

SEQ ID NO: 6963 - DNA, 77 bp, Zea mays
agaaaatctaatgtggctataggctgaggctgtagcatgctgcagtctgtgcactggagcagcatgggcgagaagcc

SEQ ID NO: 6964 - DNA, 190 bp, Zea mays
gatcctagagagctgccaggagtaagtactaccggtccgggagtggacgggatgttacatagtcaattcgtataaccgactgtgaagaatagatttagacaaaaataatgatctcagtgatcttgtgattagtattcacggagggtcaacacatgaggctagtatatgcaactggctagcaaaaaatacc

SEQ ID NO: 6965 - DNA, 168 bp, Zea mays
tgcaggcatgcaagctttgccgagtgccctctacagctactcaagcaaagaacctgacatggggacccgctgacggattcttagagagggctggcaggcaggcactcagcaaaaataccttctgtgcctagtgtactaggaggcactcggcaaagatgccgtctccgt

SEQ ID NO: 6966 - DNA, 146 bp, Zea mays
cggatcctaaggacttgttcgtttgtgtcggattgcacctggaatcgttccagctaatcaaagtttatataaattagagaatcactccggttagtaatcgttccgacccacaaatccggcacaactaaacaaggcctaaatgtttc

SEQ ID NO: 6967 - DNA, 94 bp, Zea mays
gacctaggaaggccgtcagacataaggttatgtgtgatggctctaagggctggccgttagatataagcttatgtccgacggccgtcacagattg

SEQ ID NO: 6968 - DNA, 76 bp, Zea mays
cacgttgatcaggttgcgttggtaatcggctgagttatggcattagctgaatattggctgcgctctggcaacacga

SEQ ID NO: 6969 - DNA, 95 bp, Zea mays
tctgtgctctttgccgagtgttatgaccctgacactcggcaaagcgcctctttgccgagtgttacactcggcaaagtgaccagtatgtacctttt

SEQ ID NO: 6970 - DNA, 157 bp, Zea mays
ttcagaacccctaagggtgtgttcgtttgttccggaatcttttatctataaccaatccaaccagaaatgcttatctaatttgtataggctttgatcacctggaaccattcctgccccaaaccagaacaaacgaacgcagcctaagtgatctgttgtg

SEQ ID NO: 6971 - DNA, 78 bp, Zea mays
caccagctgacgtcgaatgtcgtggtggccctggcaaagtatgtctgggcgacgacttcgtacgacgggcagccctct

SEQ ID NO: 6972 - DNA, 256 bp, Zea mays
ggaagatgatgtccgcctgactgccgttgtcaactaggactttatgcaggtcccagcctgccacgctgcaattgataaccattgcgtcgcagtggggggcactgcgcaggtcgacgtcccgtgcgtcgaaggttaacggtatgtgggaccactttgtctgcatgactggacccgtgacggcgacatggttgatgttgtggtaatggtcccgcttctgccgcttggtgtcgaagtcagtgctggacccccccagtta

SEQ ID NO: 6973 - DNA, 114 bp, Zea mays
gcaaagaatgctttgccgagtgccagcgatctggcactcggcaaagcttattttaaaattaaaaaaaactttgccgagtgccagatcacaggcactcggcaaagcgccctatta

SEQ ID NO: 6974 - DNA, 174 bp, Zea mays
cggcctcggctctcagcaggaaatcagcaagcacaagtcaacaacgcagtacccgtcatgtcactcacaggaagccaagacacccactgggaataggacggccctagacttcacatcatacaccccctagatgtataaatagggcagtggtggttcctccaagggcagaaggcg

SEQ ID NO: 6975 - DNA, 185 bp, Zea mays
tagaagtttaccagggcctttaggaagttatgcagctaacttcctatgaattactgtagcctctaggaagttaggctaacttcctagaggctacagtaaaccatagtaagttaggctaacttcctagaggctacagtaaaccgtagtaagttaggctaacttcctagaggcccagtaagtctcta

SEQ ID NO: 6976 - DNA, 136 bp, Zea mays
ggctacgtacgaggccgtcggacataagattatgtccgacggctgtcagggtagccgtcggagataaggcgatatttccgagagtgcttggtggccgtcggacataacgctatgtccgacggcatcgtagacagcc

SEQ ID NO: 6977 - DNA, 106 bp, Zea mays
cgtcggacatagcgttatgtccgacggccaccaagcactctcggaaatatcgccttatctccgacggctaccctgacagccgtcggacataatcttatgtccgacg

SEQ ID NO: 6978 - DNA, 111 bp, Zea mays
gttgacggagacggcggctttgccgagtgtcaacggtgacactcggcaacgaagatatctttgccgagtgtccgcctggcagcactcggcaaagccgccttctgtgccgag

SEQ ID NO: 6979 - DNA, 137 bp, Zea mays
gagtgctgccaggcggacactcggcaaagatatcttcgttgccgagtgtcaccgttgacactcggcaaagccgccgtctccgtcaaccggcgccgtaacggtcgcttttctttgccgagtgcaccctgacactctgc

SEQ ID NO: 6980 - DNA, 118 bp, Zea mays
ggtgactccgagggcccttagcttgcggaggccgaggatgactgcttcatactctgctatgttgtttgtacatttgtcggattccagagcgaagctgaggcgtgctgcgtatctgtgt

SEQ ID NO: 6981 - DNA, 157 bp, Zea mays
ttgtcgggccggcccaagtatggtccagtcactcgtgtcgggccggccggcatgatgggctgaaaatcaaagcccagcctagccctatactcatgccgtactggcacggcacaatatatttcgtgtcggaccgtgctttgagccagttttcttaggc

SEQ ID NO: 6982 - DNA, 131 bp, Zea mays
cacggtcgaggactggcgggacacgtgtacaagacgtgggggacgcacatgcggtgtgatactcagtggttggggtgacctagaaaaccacccaacgtatggacgacgggtttcgccaatttggctcaatt

SEQ ID NO: 6983 - DNA, 121 bp, Zea mays
ggtggcagtcggcaaagcattgccgagtgcccaacaaaaaataatcggcaaaaagccgtatcgatgtatgagacttctttattgagagtcacactcggcaaagacttcgccgagtgttttc

SEQ ID NO: 6984 - DNA, 96 bp, Zea mays
actcgcgcccgtcgcccgtcgccgcccgagcgccaccaagccatccgcggccacccccacgcgctcggccggccggccggccaccaccgccgccgg

SEQ ID NO: 6985 - DNA, 221 bp, Zea mays
ccaccccctttctttgccttcgctggatccgtcgctgccgcggccttcccggccggatccacgttgttgcgacctttctggctcgatccgccgtccctttggctggatcgtgtcttcccgactgcatccgtcgctgccgtggccttcccggccggatctgtcgtttccccttctattctgccgcgggcgcggacaccatgactggcgcagacgcgtgcgct

SEQ ID NO: 6986 - DNA, 177 bp, Zea mays
gatattcctggcgacgaggggggtcagcagcgggatgctggttggcgatgttgtgcacttgttgctgattgcggccgtctcgaccggagtctggctacggagtcctcgtccatgtgcggctggactgcggggcatctttgggtttccgctgtgactcaaccttgcgctggtggagct

SEQ ID NO: 6987 - DNA, 161 bp, Zea mays
gttgtagtactgccactcggtaaataagcttccattgccaattacggctagcacagtcgacaaagggattggcaaaggggcccactggtgctccttttgtcgagtgcgagacagacactcagcaatgagagcttctttgccgagtgtcaatttgcggctct

SEQ ID NO: 6988 - DNA, 228 bp, Zea mays
gcacggcggaccgccgcggccgagcaccgacgatgccaaaattggcctagcacagagcgaaactagagaaattgagcacggggacgggtgtctcacctcggggcggagctggcggcgtgagcagagcgcgagagagggtgaagctgagcgaaatgaggcaaggggtgtgcgcggggcactggcagggctctaagaagggagctgggcgcgtgggcgggcgtcgtggcc

SEQ ID NO: 6989 - DNA, 261 bp, Zea mays
gcgtggttctatccgaagccatctgccatggaaagagagtcaatattatgcacatgctattttttttaactagttattttattcattacatcaagccattacataacacaacaccctgctaccacaagctcatcacacgcgagtgctatctagggtactcccgaactccttctctaaagtgtccccaaagaccttgagaaggtcatcaaggctggccagggacatctcttcggtgtcggatgagttccgatggaggccttt

SEQ ID NO: 6990 - DNA, 188 bp, Zea mays
gatgttgtagaaagatactgggccagtttggtgcggcgcgtccgacgccacgacgcgcctaagccgtggcggtcaaatcggccgccacacctgcggcggtaaaactatggcacgtctaagccgcggcgacaaaattatggcgcgccgtggcggcttaggccacgcaccagacagccccactatcgaaa

SEQ ID NO: 6991 - DNA, 164 bp, Zea mays
tctctctcttcaccagttcacccgcgtcgtagtgtttctcatcctcctcacctcctgcagtgctttttaacattttacactgagttgatttagaagaaatgtatggacttttttataaaaagatgatgcaggacgaccgttgaaactggtgctttaagtatagt

SEQ ID NO: 6992 - DNA, 126 bp, Zea mays
aggcatgcaagcttgttcagttaggccaataacgctctgaatgtcctctaatctttttctggatttgcataacgcccttacatggctcttctgaattggtctaaccgaacaagctctaaagtggta

SEQ ID NO: 6993 - DNA, 184 bp, Zea mays
cttgagctgtgtgtaagcctgaatgacttgcgtctgagtgtccctgtctagtcccttttttggtgctcgtcggtcctctctttgtaacgttgtatgcctctccttttatagttcaaggggggcatgtacaagggttctgatctgtgacggaacctctcaagtcattaggcctaccaacagttgt

SEQ ID NO: 6994 - DNA, 257 bp, Zea mays
gtgctaatcgcttgcggcttgcctgcccggtctcgtggctttgtgctgctcccgctgtggtgaggaaccctaggatggcgggggtttcgatggcggcggcgcctgagggggtgctgcaccgccggattgagtttcatcttgcacggagaccgcatggctctgtggcggtgggcggcggcgggttccggatggagacgctgaacccggacgccgctggtaaggtggggcccggggaggcggtcgggagcagcgagggg

SEQ ID NO: 6995 - DNA, 107 bp, Zea mays
accctccatatccaacggtgctgcgtcaggggggtttttgtaatatgcacaaagtttctaagaacagttggggccccccgtgtcctgacatcgttcgccatggaggg

SEQ ID NO: 6996 - DNA, 66 bp, Zea mays
gacgtggccgcaacggctagttgcgtctagggcttacctggctctgacgtggcggcggcgcggcct

SEQ ID NO: 6997 - DNA, 82 bp, Zea mays
tgtatttcgggtatccgacccgataggaccgacgggtgagtttttgtacccgtatccatatccggtgggtacgaaacccgcg

SEQ ID NO: 6998 - DNA, 76 bp, Zea mays
tgcagtggcaaagcactcggcaaagaagccgtcactggaaccggtaaagcttctttgtcgagtgttgctgccttgc

SEQ ID NO: 6999 - DNA, 112 bp, Zea mays
gactaggtgagtgtccgtgcgttgcaatgaagccatataatactcacatgttatatataagtcactgtgatattatatgtcaccgttgcaacgcacgggcactcacctagtt

SEQ ID NO: 7000 - DNA, 255 bp, Zea mays
aatttctaatcctgaggaggcatcagcgaaccttaaccaccagcttaacgttccttctctatggagattattattctcatgacttggagcatctggaaaagccgaaacgagtgattgttttcaaacaaagatccttcggtacatcgctgtacgcaggaattcagcaaagagccgtggttgatcattcacagagcgtgggggaattttgacacctctatcccgaattggctgagtctgtggcaggcataggagtag

SEQ ID NO: 7001 - DNA, 75 bp, Zea mays
atgcccgcctccttccttcccctcctcctctacgaaaccttgggtgtgggggaggcgagggatggggtctctaat

SEQ ID NO: 7002 - DNA, 231 bp, Zea mays
actaatatacaagcacatactaggtgcaagcgtccaaacagacttttttgtccattagatttaaattcaatggcagataaaattatggtttgttagggttttttttataaagctacaatagatgatggtggaagggtttaagtgctaaatatgacataccgttggatttagatcaaacagagtaaaatatctaatcgcatgcttacatctagtatctgcttgcatattaga

SEQ ID NO: 7003 - DNA, 95 bp, Zea mays
cggattccttcactatagggtcctcaaccttgtagatatcacgctcgaaatcctcatcagcttagtcgaagacctcatagtgccagcacccttcg

SEQ ID NO: 7004 - DNA, 114 bp, Zea mays
taggtgagtgcccgtgcgttgcaacggaaccgtataatgacacgataacttatgtacatacgtgtgttatattggtatagatatgtgtccgtgcgttgcgacggaagtaaaaga

SEQ ID NO: 7005 - DNA, 233 bp, Zea mays
ttcccgagccgggacgtggcggcagacggcgacgttaggaagtccggagacgccggcgggggcctcgggaagagttatcttttctgcttaacggcccgccaaccctggaatcggttcagccggaggtaggggtccagcggccggaagagcaccgcacatcgcgcggtgtccggtgcgcccccggcggcgactagccattcacgaccgaattccgtccacgcccggtcgataac

SEQ ID NO: 7006 - DNA, 85 bp, Zea mays
gcggtacgtgggaccacttcgtctgcacgactgggccggtgatggcgacgtggttgatgctgcggtagtggtcctgcttctgccg

SEQ ID NO: 7007 - DNA, 194 bp, Zea mays
tttagggggtgtttgggatggctacaggttccaactccagtgtggagctatagtttataacatcaatttaattagttttaaaaatatttttaatctaaataataaatgaaatgacttatctaaatgtattctaaaggcttacaactctagctccacgattttctaaacctagagctatcccaaaaaggctttaa

SEQ ID NO: 7008 - DNA, 128 bp, Zea mays
gacactcggtaaagtctgtgccgagtgcccgagaaaaagtactcggcaaagaagcctttgccgatgtactgttcgtcgagccctctttgccgagcgcgacactcggcaaagactttgtcgagtgtttc

SEQ ID NO: 7009 - DNA, 110 bp, Zea mays
tggaaaaggtgttgtgtatagagcacttcccaagtcctgcaattatttgataaaccatgtaatcatttatagtagtactaggtgagtgcctgtgcgttgcaacggggaca

SEQ ID NO: 7010 - DNA, 143 bp, Zea mays
  unsure (55): n = A, C, G or T
tgacacatggaccccacctgtaggcgcgtccgcatcgacactcgcttgctccctntgagccactgacagcccatccccacgcgtcagccctcacctcgcacttgtccccgttgtccctcgccagtgggacccacatgtcatct

SEQ ID NO: 7011 - DNA, 86 bp, Zea mays
ggacccgatactcggcggcataggctgtggcgccgaggtaacacagctcggcaccacagcctatggcgccgaggtatgacgtggca

SEQ ID NO: 7012 - DNA, 104 bp, Zea mays
cgattgacgagttgagcgactccgacgatttaacggcggccgcgacagcgagcagggtcccaaactcaacgccgacgtcgaggagtgctaacactacggtcggg

SEQ ID NO: 7013 - DNA, 179 bp, Zea mays
gttttttaagctggtgcccaaagttttgctggtgtcctcatttttacccttagtcatgtttttactcagttttgtctttctgttatatagcacttcaagagtaaaactgagcaaaaaaaaacacgactaagaataaaaataaagacaccagcaaaactgagggcaccagctttaaaaaa

SEQ ID NO: 7014 - DNA, 90 bp, Zea mays
cctcctccatcagccagcagaacaagacccagtatcaaggaagggccacgaggccatccaccgtcgatgctctgaaggctcaaacacacc

SEQ ID NO: 7015 - DNA, 156 bp, Zea mays
gggttttcttaggccttgttcgtttgtgtcagattgtacccggaatactgtaactaggttcattgtttatataaattagagaagcaatatcctgtccctagagatcacttctcgacccactaatccggcacaaatgaataaggccttaaggaaccc

SEQ ID NO: 7016 - DNA, 63 bp, Zea mays
atagcctatggcgccgaggtacgtgctacgctggcacacctagatgtcgtggcgccgacgtgg

SEQ ID NO: 7017 - DNA, 109 bp, Zea mays
tgacgcctgtcggctgacaaccgacgggtttaagccttaaaccgatgtgaattacttattcccgtcggtttaaggcttattcccgtcggttcctggccgacgggaatta

SEQ ID NO: 7018 - DNA, 213 bp, Zea mays
gactgaaacaagtaactgctgtattgctgtccaaaaatctgcatgtgcacatttgatggttgagttcacccttttggctaaaaatgcttaattagcacttaacgaacttagatttgtgatgtctaaacttaagttaacatgtgtccatgatcaatgtgcttgcttgctgtagttgagtgtagataggagttccgtagttattgatgtctatgt

SEQ ID NO: 7019 - DNA, 99 bp, Zea mays
gcgatcccaccccgccgagttgctcagcgggtgtgttgttggtcgagcgggttagtcgacagttccgccttgctgagttgctcgacgggagtgttggtc

SEQ ID NO: 7020 - DNA, 130 bp, Zea mays
aggctgtttgcagcccctcacaaaaatgaggataggccccacctgtaggccaataacacaactaaaacgttatctagtagacttgcaggtgaggtctatcctcttttttgttaggggctgcaaacagcct

SEQ ID NO: 7021 - DNA, 245 bp, Zea mays
cagcgtgagggtcgctctaaatcgctacagggaaaggggagcgcgggtgtagcggatggcgctgcagctagccttatatgccctaacgtcacgcaggccatctcggcctctccgctacggccggaatctgcactcgcgcggctggatgcccctcccggctcccagttccccggccccacctacgtaccgtgcggccgctggtctatcctcgtgcgacctgctagtatttcggtgcccatttcacg

SEQ ID NO: 7022 - DNA, 78 bp, Zea mays
catgctggtctggcactcggcaaagaaagctcaagtgggccctcatgcgagcctctgtgccgagagccgcaagctggc

SEQ ID NO: 7023 - DNA, 212 bp, Zea mays
acaagaagctctttgccgagtgccacgcaaaaaacactcggtaaaagaaaacactcggcgaggagtttctttgccgagtgttgtatttttgacactcggcaaagagccctttgccgagtgccaaaaatataacactcggcaaagaaactcttcgccgagtgttttcttttaccgagtgttttttgcgtggcactcggcaaagagcttcttgt

SEQ ID NO: 7024 - DNA, 71 bp, Zea mays
tcgtatatcagatgcttccatcatcacagctttccgcaaggggtacgtgatgaaaagaagttggaaaagtt

SEQ ID NO: 7025 - DNA, 140 bp, Zea mays
tacatccctatgggctgatttggtgaccaggtatcacgagaggatctatggggaaggtatcttcatgttattcaattttgaatagcaagggaattccttccccatggatccctgatcaccacagcagccctatattttat

SEQ ID NO: 7026 - DNA, 77 bp, Zea mays
ggtttttgaaatgtgaccgttgatggacatgttactgttgtactgcgtgtttcccgaaccgtcgcgtcctgtctata

SEQ ID NO: 7027 - DNA, 97 bp, Zea mays
acctttgtgcaaatgacttgagaggtgtaggattaagtgggaaccttccgggccgcagtgaaatacccactacttttaacgttaattttacttattc

SEQ ID NO: 7028 - DNA, 157 bp, Zea mays
agtgttttttaggcactcggcaaagaagtttcttatcgaatgccaaacaaaaaacactaggtaaaaaaaacactcggcaaaggatttctttgccgagttttttttttatttttgacactcgataaaaagcttctttgtcgagtgtttttttcaacat

SEQ ID NO: 7029 - DNA, 145 bp, Zea mays
gtgcttttcgacgtctttgccgagtgtctgaaaaaattactcgtcaaagaatactttgctgataaaatatttgcagagtattttttgccgagtgtaaaatggaatttgccgagagactaagacactcgacaaagaacgcgagttc

SEQ ID NO: 7030 - DNA, 150 bp, Zea mays
tccagaactcgcgttctttgtcgagtgtcttagtctctcggcaaattccattttacactcggcaaaaaatactctgcaaatattttatcagcaaagtattctttgacgagtaattttttcagacactcggcaaagacgtcgaaaagcact

SEQ ID NO: 7031 - DNA, 255 bp, Zea mays
atcgggttaagagcgcgacggtgacgtggcggcagacggcgacgttaggaaggcggaaaagctccgcgggggcttcgggaagagttatcttttctgcttaacggcccgccaaccctggaatcggttccctttggaggtagggtccagcggccggaagagcaccgcacatcgcgcggtgtccggtgcgcccccggcggcccttgaaaatccggaggaccgaattccgtccacgcccggtcgtactcataatcgcat

SEQ ID NO: 7032 - DNA, 113 bp, Zea mays
tgactcttcgtcgagtgcttggcgctttgtcgagtgcttcctatcgggcactcggcaaagaggtttttgccgagtgccgcactcggcaaagtcctgctctcggtaaggacggc

SEQ ID NO: 7033 - DNA, 109 bp, Zea mays
gagacagtcttagggctagtttgggagccgtaaaaccggaggggctaagattttagcccctctaatcatctcctgtttttggactcccaaactagcccttagggtagtt

SEQ ID NO: 7034 - DNA, 253 bp, Zea mays
gcgaactacggaggcggcgacgcggctgagatacgaagagagtgatagagaaagaaggaaataccagcgctatgtaaacgcgctttgccgagtgcccgtgatctggcactcggcaaagattttttttattttaaaataagctttgccgagtgccagatcggggacactcggcaaaggctcctttgccgagtgtcgacgaggtgacactcggcaaagtctaacttacacttctttgccgagtgccacccagtgg

SEQ ID NO: 7035 - DNA, 120 bp, Zea mays
tcggcaaaggagcctttgccgagtgtccccgatctggcactcggcaaagcttattttaaaataaaaaaaatctttgccgagtgccagatcacgggcactcggcaaagcgcgtttacatag

SEQ ID NO: 7036 - DNA, 108 bp, Zea mays
ccgtcggacataagcttatgtccgacggctgtcagggtagccgtcggagataaggcggtatttccgagagtccttggtggccgtcggacataacgctatgtccgaccg

SEQ ID NO: 7037 - DNA, 151 bp, Zea mays
gtaggttgtcatcgttcgtcttcgttcgtcttcgtatcgtgtagcagcgcgtcccttatcgtgcccatggttaatactgccattcctgctgtgcctcgcttctgttgtgtttgattaaatgtcggaccaagattccacgatgtcactcatc

SEQ ID NO: 7038 - DNA, 155 bp, Zea mays
gtcggatccagttggggtcatcacaggccgccgggccctccgtcgcggttacaggagggtgatgggaagggctcgtgcttccacttcctctgctccatccggcaccaatggcggcaggtcagggcttcctgctggtggcgttggcgatcctgaca

SEQ ID NO: 7039 - DNA, 233 bp, Zea mays
cgcataaactgcatggttatctattttgctacaaacattgctaccaactctagacataatgatgaggacatcacctgcaacatgagtacgactacaccagcagcacctccacatcaagcgccacttccttcattagctgggccaatcactcgggctcgtgccagagatcttaacttcgtcctgctactgaagaatgagggcccagaagaatagacgaccagcccaactacggc

SEQ ID NO: 7040 - DNA, 93 bp, Zea mays
ataggtgagtgtctgtgcgttgcaacggagacatataatacataagttaccgtgatattatatgtccccattgcaacgcatgggtactcacct

SEQ ID NO: 7041 - DNA, 249 bp, Zea mays
ggcaagaaaaggtttctcgacgataagaagggaaataaagacgaccagctacttgaagtagtctgggccctaaacacgaccgaatgccaggcaaccggattcacactttttttgtctactatatggatcggaggccatgacaccggaggagataaagcatgggtcaccccgaacaagcacatcagcagtccccgacgtagacgaaccaacgtctaaagacctcatcgacggagaccgtgtcttcgccct

SEQ ID NO: 7042 - DNA, 80 bp, Zea mays
gcgaaactgggatgatctgaaaggaagtcgcgcccccgcaaggcgaggggccggatttcggcggaccattcacgcgcatg

SEQ ID NO: 7043 - DNA, 189 bp, Zea mays
ctgcgatcaagttccgcgagctcaacgccgtcaccaacttcgacatgagccgctacgacgtggagagcatcctcagcagcgacctccccgttgtgggcggagccaccgggcgcgccgccaagttcccgttggactcgctgcagccggggagcgctgccgcgatgatgctcgctggggctgctgccgctt

SEQ ID NO: 7044 - DNA, 113 bp, Zea mays
cgaggatttagagtggttcgggccgccagagcgtaaaaccctactccactgtgtgttggattgttgaggaagcttgtgctgtgtgtaagcctgaatgacttgagtcttctttc

SEQ ID NO: 7045 - DNA, 77 bp, Zea mays
gttggctcggggagactctggcggtcacgtcgaggtacggcttgtcgtcggggatggccggaatcgcccgggtcacg

SEQ ID NO: 7046 - DNA, 177 bp, Zea mays
tacgcgtctagctgcatggatgttgcagcgatccaaaatttatggaggaaataaagcatttacaaatagaaaccggcacacatatctttcctaaatttatgcgcatgcattgtatcgtgtttgactcatgcatgcattcttttctttgcgctaacagacgtggggcaggtgacacac

SEQ ID NO: 7047 - DNA, 154 bp, Zea mays
gccagtgatggagactttgccgagtgtttggctaggcacttagcaaagcggctttcttgacaagtgctggctctgaggcacttgcaaagaaagctcctgtggccccccatgcgcagtgcctttgttgaaactatgttaattttttatcacacac

SEQ ID NO: 7048 - DNA, 95 bp, Zea mays
agcgaggtcgggtgctaggcagacccacagggcacggtaccaaggcgggagaaccagtcatagtgcgtgggacgggcttagcaccaggtggccac

SEQ ID NO: 7049 - DNA, 81 bp, Zea mays
tgtagtgtggtcttgcgggcctggccgccgccgctgcgcatcgcagcgatggcgtcccaggcctccttgaaagtccgcttc

SEQ ID NO: 7050 - DNA, 173 bp, Zea mays
aatcctcgattcaggttgccggttaaagacggtggttggcttcttagcttttattgggtcaggttgcactagttatcgctgcttgcgggaaggtaacttggcttcttcgaagctagttatctgaagatttatactacgtcgtgaagatcgggcatcgtgacacatcaaggatc

SEQ ID NO: 7051 - DNA, 111 bp, Zea mays
cgactcgacgccatagatcttggcgccgagatacgtccttcgctggtaacaacaggctgacggggtgtcgatgtagccgagctcggcgccatgattcatagcgtcgagatc

SEQ ID NO: 7052 - DNA, 125 bp, Zea mays
cttggcggatctcgacgctatgaatcatggcgccgagctcggctacatcgacaccccgtcagcctgttgttaccagcgaaggacgtatctcggcgccaagatctatggcgtcgagtcgtgttacc

SEQ ID NO: 7053 - DNA, 230 bp, Zea mays
ccacgcccccgctccgcatccaccgcaccacgcttaccaacatcatcaggaagtacaaatcgtacctcctccacccccaccaccacaccagcaacaccaaaacattccccatcccccaaagcaagaagacttcgccgatcaaccttatcgcgggagtcattcacatgataacaggggggtcaagcaccgacttcgacaccaagcggcagaagcgggaccactaccgcagc

SEQ ID NO: 7054 - DNA, 70 bp, Zea mays
cgtattacgactcgcgcagtggctattgcacgtccacgaggacgtttcatatcatgcgcgcaccatcgtt

SEQ ID NO: 7055 - DNA, 77 bp, Zea mays
tttctatcaaacactcggcaaagactttatcgagtacgcaaaggtactcgacaaagactttatcgagcactcaaagg

SEQ ID NO: 7056 - DNA, 96 bp, Zea mays
attcttattggactttgtgtgcggtgtggcccctgggagatgggggcccaggtcggccgcccctcccgccctacctcaggcacggccctgagtcct

SEQ ID NO: 7057 - DNA, 197 bp, Zea mays
tgcctgcttgtgcttggactttggatcgctgcatgtcctatggtctcctgccctgttggtgttgctgttggactctggtcattggcacccggtaaaagaaggaggaacatttgtttcctgcttgcaagttttctggtgcagggaacacctgagtgcaggactgcagcagagttaggtgtccacagcatcaactagga

SEQ ID NO: 7058 - DNA, 87 bp, Zea mays
ggacccgatgctcggcgccatattgttgtggcgccgaggtaacacagctcggcgccacagcctatggcgccgaggttttgacttggc

SEQ ID NO: 7059 - DNA, 151 bp, Zea mays
aaaaatctcttagggctagtttgggagcctaaataccgaagagaattggaagggctaaaatccccaccttattcaaaattgtataatgagagaaatttagcgtctccaattccctccgattttgtggctcccaaactagccattagagttg

SEQ ID NO: 7060 - DNA, 121 bp, Zea mays
agtttagaaagctgatttggtgaccagagattatgggtgggggacggggggtttgaacgagaaattagttcatttccctccaattcccctgattcttttgtcaccaaatcaactctaatgg

SEQ ID NO: 7061 - DNA, 160 bp, Zea mays
cgccaacaatttgcagcggaaatcttattaccaaatattacaagtgacatcaagtttacattgtacatgatcggagtgattacgaaagtgattcaaggaaataactttgaactgttataaattatctatagttttgagatatatgctagctcaagtgacc

SEQ ID NO: 7062 - DNA, 85 bp, Zea mays
aaattaaaaacgtgggtacccacgttcttcgtcaaacccatgaatttaactaaaataagaacgtcggtacccacgttcttagttt

SEQ ID NO: 7063 - DNA, 146 bp, Zea mays
tagtaatgatgtgcttggttcggtgtcaacgaaggatgagataggattaatcctgagttgatcccatcccttattttttgagggatgaccccatccaatatttttgaagaatattccttgaccctgactctgtacctccaaaccaa

SEQ ID NO: 7064 - DNA, 222 bp, Zea mays
aaaattggtgcaacccgctgcaaaccagaatgtttgcagcccctcacaaaaaaaaaagtttgacctcacccgcagcagcgctctaaaaaaagagatttggccccacccgcagcagcattaacacaactaaaacattatctggtgaacctacaggtgtggtcaatcctctttttttgtgagggactgcaaacattctagtttgcagccgtctgcaccaatttt

SEQ ID NO: 7065 - DNA, 128 bp, Zea mays
aaaaaaagaggattgaccacacctgtaggttcaccagataatgttttagttgtgttaatgctgctgcgggtggggccaaatctctttttttagagcgctgctgcgggtgaggtcaaactttttttttt

SEQ ID NO: 7066 - DNA, 109 bp, Zea mays
accgaaaacagcttctttgccgagtgtctgaagcactcggcaaaggctggaaaagactcggcgatgtctttgccgagtgtgacactcggcaaagaatgcttacatcccg

SEQ ID NO: 7067 - DNA, 90 bp, Zea mays
gttaggacccgatgctcggtgccataggctgtggcgtcgaggtaacacagctcggcgccacagcctatggcgccgaaatctcaacggcgg

SEQ ID NO: 7068 - DNA, 99 bp, Zea mays
gcccttccatcagacactcggcaaagaagccccctttgccgagtgcctcctagagctctcggcaaagaaggcttctttgtcgagtgtctagaaggacac

SEQ ID NO: 7069 - DNA, 76 bp, Zea mays
tgccagagatctggcactcgacaaagagtattttaaaattttaaaaaaatctttgccgagtgccagatcgcgggca

SEQ ID NO: 7070 - DNA, 134 bp, Zea mays
tgccagtacagtagacactcggcaaagagtgagtctttgccaagtgtccgtgtggcacttggcacagtttccgccgaggtcacctagcacctcgacggcgacttttctttgccgagtgccctacaaaaagtact

SEQ ID NO: 7071 - DNA, 180 bp, Zea mays
aaccactgccgccgcccatttcttcttcgaccggttgccgcctgcgcgcggcactgctcgtacgtctccccgccagtgcttactgtaatgcatgcatgcaggtccaggagtgctacgaggtctcagccgactacgagggcaaaggagacacgacgaagctgggcgagctcggcgccaagc

SEQ ID NO: 7072 - DNA, 237 bp, Zea mays
ttgaaggccgaagaggagaaaggttccatgtgaaggcatagcgcggtggcgtaagctgatcctaagggacgggggaacctgagaggataccgcgatcacgcgcgtcacccgaaagggaatcgggttaagatttcccgagccgggacgtggcgtcagacggcgacgttaggaagtccggagacgccggcgggggcctcgggaagagttatcttttctgcttaacggcccgccaaccct

SEQ ID NO: 7073 - DNA, 208 bp, Zea mays
tcgtcgcttcgcgtgttgtcgagcctgtcgttttccctgtcttgtgctcgcgcggtttccttgccagcgtgccctctcggctcgctcggctttaaaatccctatctcgtcgttgttccgcgcgacatcaagaaccccaagaatcggatgaagatgaagctagcagtgcgatatttcccaagcgctcgacaaattgcttggatcggaaa

SEQ ID NO: 7074 - DNA, 92 bp, Zea mays
gcggtaggctttttacatcacaggcggttcagatagaaaaccgcctgggatgtctcaggctattcggaccgcctgtgatgtattagtatcac

SEQ ID NO: 7075 - DNA, 189 bp, Zea mays
tttagagggtgtgtctggttttatggactaatttttaatcccttcattttattctattttagtctttaaattatcaaatacaaaataaaaatagtgttttagtttttatatttaataatttatggactaaaatagaataaaataaaataactaaaaattagtccctagaaaccaaacgtacctacagtt

SEQ ID NO: 7076 - DNA, 114 bp, Zea mays
gcaaagaacactttgccgagtgccagcaatctggcactcgacaagaatattttaatattttaaaaaatctttgccgagtgccaggtcgcgggcactcggcaaagacgtgtaaat

SEQ ID NO: 7077 - DNA, 73 bp, Zea mays
gcatgctgcacgtgacgtaagccaacgagcggagcctgattctgccacgtggcatgctgcacgtgacgtaagg

SEQ ID NO: 7078 - DNA, 111 bp, Zea mays
ttggttcatggctaaatgtgccacactttgcctaaggttagtcgttcgaattgaagaactaaccttagacacaaaagttaggcaaagtgtggcaagttagccatcacacca

SEQ ID NO: 7079 - DNA, 75 bp, Zea mays
gcctggactcgcgtagaggtcgcgacgagataggccctcgctgaactccctcgggatgactgcgtggtcgcgcca

SEQ ID NO: 7080 - DNA, 100 bp, Zea mays
agtgttctaggtgacactcggcaaagagattacctttgccgagtgtattaggtggcactcggcaaagagttttcctctttgccgagtgtccgcaagccta

SEQ ID NO: 7081 - DNA, 111 bp, Zea mays
ttggttcactacctcagttgccacatttgcctaacttttctgactaaggttagttatacaaataagaacgactaaccttaggcaaagtgtggcacatttagccacaaacca

SEQ ID NO: 7082 - DNA, 84 bp, Zea mays
agtgtggcgctggagtcggtggagacttgggggctggggtagacctgctcggagaagagttgcctactcctccagtgtaacact

SEQ ID NO: 7083 - DNA, 146 bp, Zea mays
ggacccacagaggccttgttcgtttctaccggatttgtggattggaacgattgctaaccggattgtttctctaatttatataaactttgattaggtgaaataattccgggtgcaatccgatagaaacgaacaagccctgaaccact

SEQ ID NO: 7084 - DNA, 145 bp, Zea mays
tgccgagtgcgtcctgtgccgagtgttcagcactcgataaagggtatctttgctgagagcctaaatttaccgagcgcggcactcggcaaagccttctttgccgagtgcccgataaaaagcactcggcaaagccgccggcactcgg

SEQ ID NO: 7085 - DNA, 73 bp, Zea mays
cggcgttgtggacggcgacagagtggacggaggcagcagaggaagtccgactcgcgtcaccgcgccagcgtcg

SEQ ID NO: 7086 - DNA, 127 bp, Zea mays
ggcaaagcgtgcttctttgccgagtgtccgggccattacactcggcaaagaacctataccggtgcccaggtcttggttctttgccgagtgctatggcctggacactcgacaaagaacctctttgccg

SEQ ID NO: 7087 - DNA, 242 bp, Zea mays
ccaactccagcagcactccgcatgcggctccgtatccctattttgcggagtctagcacactattcatcagtccagcaggctccgcatccggctccgtaaaacgcacggcctgtaccctgactccccatttccacgctttctctctcctctccgcagctctctgcgtgcgcgcgcggctgctcgcgggccccaggtgtcatagactgcatgcggagtgggatggggagtgttgctggaaacgg

SEQ ID NO: 7088 - DNA, 96 bp, Zea mays
agtgttggaaaaaagcactcggcaaagagctctttgccgagtgttatatttttgacactcggtaaagaagctctttatcgagtgttaaaaaaacta

SEQ ID NO: 7089 - DNA, 85 bp, Zea mays
tgacgctcggcataggcggctttgtcgagtgtctggctctcggcaccacatggcactcgacaaagcgccctacagctaacggtcg

SEQ ID NO: 7090 - DNA, 167 bp, Zea mays
aagtgatatcagagccgactctcgaggttacacagaaaatgtgtggactagggggttcgggtatatatggcgcatggcgcatgtgggcccggagtggtcacatggcatgacatatgacgacactagacacacagacgtggctaagaggggaggttcttatattgggg

SEQ ID NO: 7091 - DNA, 84 bp, Zea mays
tctcgacaaagacgtctttgccgagagcctttttatgtcgagactcgaaagtttggctctcggcaaagactctcttcgtcgagt

SEQ ID NO: 7092 - DNA, 84 bp, Zea mays
actcgacgaagagagtctttgccgagagccaaactttcgagtctcgacataaaaaggctctcggcaaagacgtctttgtcgaga

SEQ ID NO: 7093 - DNA, 94 bp, Zea mays
taggctctcgacaaagacgtctttgccgagagcctttttatgtcgagactcgaaagtttggctctcggcaaagactctcttcgtcgagtgcctt

SEQ ID NO: 7094 - DNA, 178 bp, Zea mays
tggtcgagccggaccaggtccagacgtctataaaagaaaatccatagtgctagggatcagtttttcacgcccatctcgattcattagcgacggtggttgcccgatagtgcgcgcggcgatggccgcggctccccaacctcgacatgcggtggcggtggttcctaggccggcgatggcg

SEQ ID NO: 7095 - DNA, 95 bp, Zea mays
caagcgagctgctaacttcctagaggcggtcgtaggaagttagcatggacaactaactttctacaacctcctctaggaagttagcttttagttgc

SEQ ID NO: 7096 - DNA, 96 bp, Zea mays
atggtttccgtcggcgtggctaaggttgtaagagacttgctttactttatgtgccgtgaagttctttatcaataagggctattctacaatacaaat

SEQ ID NO: 7097 - DNA, 76 bp, Zea mays
ttccatcctaaatcatcgcgtgcgttgactttgacagagcgtctgtttggtttgctttacgcgagaaatgctggct

SEQ ID NO: 7098 - DNA, 187 bp, Zea mays
tgccgccttcgccgagtgtttggcactcggcaaagattctttgccgagtgctattctgtgcgagagccctgctctcagtaaactcggtcgttaccgagagcgggactttgcggagtgcggtactcggtaaaggctttttttgccgagtgcccgacaaaaagcactcggcaaagcgccgagcactcga

SEQ ID NO: 7099 - DNA, 107 bp, Zea mays
gccgagtgctcggctgtgccgagtgtcctacactcggtaaactagctctttaccgagcgcaggacgttgccgagtgcggcactcggcaaagccggatttgccgagtg

SEQ ID NO: 7100 - DNA, 78 bp, Zea mays
gatcctagaaagctgccaggagtaagtacgctggtccagggaatggacggggtgttacaagtggtatcatagtcgacc

SEQ ID NO: 7101 - DNA, 249 bp, Zea mays
acactttagaccaacccagcgggtcccataaaggcatcccgcatgtttatatatatgagaccgcgatcactgttcatctcttcaacaagttgcagacgtcgatgcgaaaaacgggcatcccctctccatactgccataccccccaaatctagggtactctccctcctttccgtatctttcgagctcgtatataggagctgctgaaaccaactgccttttaggatgtgtttggttggggagccaactaga

SEQ ID NO: 7102 - DNA, 119 bp, Zea mays
agcactagatgacactcggcaaagactttggcgagtgcacgttgccgatgtacagttcactgagacctctttgctagagtcacactcgacaaagtctttaccgtgaattttctaggctt

SEQ ID NO: 7103 - DNA, 170 bp, Zea mays
tcatattatgtgttttgccgagtgcctcctaaagaactcggcaaagaacctggcaaaggaaacccgctggtggatccttttgccgagtgcataaaggtagacactcggcaaagaggtaactttctttgccgagtgtattaggagacactcggccaaggcgccgtctccgt

SEQ ID NO: 7104 - DNA, 147 bp, Zea mays
gtaaagagagagcctttgccgagtgtcaccaaatacgctcggcaaagggaaactctttgctgagtgtcagtacagtggacactcggtaaaggggaactctttgcccagtgttactctgtgggcactcggcataggctccgttgttgt

SEQ ID NO: 7105 - DNA, 120 bp, Zea mays
aaagtggccttaggcgagtcgtgactgcgcctgctacccgggcttggcctcggatgagtcgtgactgcgtctgctgcccgggcttggccttggatgagttgtgactgcctgtcccgcttg

SEQ ID NO: 7106 - DNA, 240 bp, Zea mays
cacacgaaataacttagggcttgtttgtttcctccggaatggctggcctgaataattcagggctggaatggttcactaatttatataatcttgataaggggacgttcggtttttccagaatggtggcccggaaccgttcctagcttggattgtttctctaatttgtataaattttgatcacttggaacgattcacggtgtattcttgaagaaacgaacaaggcctaagttggaacgattc

SEQ ID NO: 7107 - DNA, 75 bp, Zea mays
tgccaggtagcactcggcaaagaacccgctagggagggtccccatgtcaggttctttgtcgagtgctacctggca

SEQ ID NO: 7108 - DNA, 124 bp, Zea mays
tgttatgtccgacggctatactgacagccatcagagataaggcttacgtccgacgactattagtatagtcgtcggacataataataactaccgatggttgtcaatatagccgtcgaaataatag

SEQ ID NO: 7109 - DNA, 149 bp, Zea mays
tttattagttaataatggcagccatcttgcttgaggatacattccagcagttcttgctggtactgaagtgtacaagatgcttgggaatgcggaaactgactctaaactttgttttgttaagcacttgagcagccatattaggtagacga

SEQ ID NO: 7110 - DNA, 182 bp, Zea mays
ccccagaggtgtggccgggggcacgattggcataacgcccaccccccgcgctcacccctgactactgtataaagacatagtacccacgcggctatatttagtcgcgtgctctaaaagagctgtgtgtgggacaaggccatgactcgccccagcctcgggcgactactctgggccagcaacag

SEQ ID NO: 7111 - DNA, 131 bp, Zea mays
acacaacgtcagcaacgaccgtcgtcccagcacacaagaattcatggccggtaagtagcgacttatatggcaggccggttgggcttcagatggacgatgagctggacggcgtgattgcgctgtcgttggat

SEQ ID NO: 7112 - DNA, 254 bp, Zea mays
ggtcagtagcgacttacgtggcagcgttgcgcttcaggtggacaatgagtggagacgggctctgcgccgtcatcggatgcagtacccagaaacatcaaggggtcctctacgttggcgacgaccatgaggtccccctacttgacgatggacagcgcggtgcaggtgccgccgctctagaccacgtccaagtgacgactgcgccgaagcttgtcgtacacagcggcgcatgcggccacgtaggactgcttctagag

SEQ ID NO: 7113 - DNA, 98 bp, Zea mays
aaaataattcttatgtccgacggctttcagagaggccctctgacataagcttatgtccgacggccgaactgatagccgtcggatataaggttttttaa

SEQ ID NO: 7114 - DNA, 158 bp, Zea mays
ctcgtcgtcccttaaggccttgtttgtttgtgtcggattgatgggtcggaacgattccgagccggattgcttctctaatttatataaactttgattaaccggaacgattccggatgcaatccgatgtaaacgaacaaggcctaagccaactctcattg

SEQ ID NO: 7115 - DNA, 99 bp, Zea mays
gccggcttgcccatccctatgttggtagtgtctgacggcgctctagcgaaagctttgggtctctgcagacctacagcggcaggaatggcgtaaggctgg

SEQ ID NO: 7116 - DNA, 136 bp, Zea mays
tttacacatctcggtgccatagatcttggcgccgagctacctgccgctctgtcgtccaccatctgacgccatctaacgcggcgtcgatgtggcaccaagctcgacgccaagatctatggcgcatgagcttgaatgt

SEQ ID NO: 7117 - DNA, 161 bp, Zea mays
gagaagttttctcgggtgcgcatgagtaaggacaaagtgcgcacaaaagacaaaaaaatggtttatggggacggtctatggtcttagggggctactaggagtaagtaccgccggcccgagagtggacgtgttgttacaaatggtatcagagctgaccctcc

SEQ ID NO: 7118 - DNA, 112 bp, Zea mays
ttggttcaatacctcagttgccacattttgcctaacttttctacctaagtttagttattcaattcgaacgactaaccttaggcaaagtgtgacacatttaggcacaaaccaa

SEQ ID NO: 7119 - DNA, 185 bp, Zea mays
cgaagtaggctttgccgagtgccgccgtgacatggcacttggcaaagaagaacctcgtgggcccctttgctagttcatttgccgagtgcccgctggactagctcttagcaaaaggagcaccagcgggcccctttgttagttcctttgccgagtgcattaggaggcactcgactaaggttgcttct

SEQ ID NO: 7120 - DNA, 96 bp, Zea mays
gcaactaaaagctaacttcctagaggaggccgtaggaagttagctgtccatgcttattttttacggccgcctctaggaagttagcggctcgcttga

SEQ ID NO: 7121 - DNA, 181 bp, Zea mays
caagcgagccgctaacttcctagaggcggccgtaaaaaataagcatggacagctaacttcctacggcctcctctaggaagttagcttttagttgctgactaacttcatacggtcgactctaggaagttaactgcccatgctaacttcctacggcctcctctaggaagttagatttcagctt

SEQ ID NO: 7122 - DNA, 99 bp, Zea mays
cggttctttgccgagtgttgtgcggggcactcggcaaagccttcctctttgccgagtgccacgtccaccgcactcggcaaagaacctataccggtgtcc

SEQ ID NO: 7123 - DNA, 71 bp, Zea mays
tcgtatggcctcggttagacctgcaaccgagtgttcaacggcggtgtcatggttgttctgggcgccatgat

SEQ ID NO: 7124 - DNA, 85 bp, Zea mays
catcttggcaccagaggtgacgcagaggaggaccgacaacaatgaccactcgccatcgtcggggtagcttttgtgccggcctgcc

SEQ ID NO: 7125 - DNA, 103 bp, Zea mays
tcggttaaaatcctttacttccaacggccacctaggaaaccgtcggacataagcttatgtccgacggcttatcggacagccgtcggacataatggagccgtcg

SEQ ID NO: 7126 - DNA, 86 bp, Zea mays
gccttcgttccgtgaaaaccgaacggcaccttagggatgaaacgaacatgacctaaggccttgttcgtttctgctggattggtggg

SEQ ID NO: 7127 - DNA, 70 bp, Zea mays
tcccaaaggatcgagtcttctggtgtcttgtcttgtttgctgagcccggaggacttggaactttcttttg

SEQ ID NO: 7128 - DNA, 205 bp, Zea mays
gcccgtgatctggcactcggcaaagattttttttaattttaaaatatactttgcagagtgtcctcgatccggcactcggcaaagtcttctttgccgagtgtcccccgggcgacactcaacaaagactatttcactacactttgccgagtgtcaaccatttgaccctcggcaaaggcttctttgccgagtgtcatctctggacact

SEQ ID NO: 7129 - DNA, 164 bp, Zea mays
tatttcatgttttggacccttagctcggcgctatagcttatgacgccaagctaacacatgtcggcgtcataggttatgacgccgaactctgacgtggcgctgatgtggcttcctagtttggtgccacagatcttggcgctgagctaagaagtcctataaatcgg

SEQ ID NO: 7130 - DNA, 132 bp, Zea mays
ctcggcgaacggcggcgctcggcaaagggccgtcagcagccgtctatagctgacggctgttatctttgtcaagcgccgagctttggcacttggcaaagaaggcttctttgccgagtgtcccacgaccagagc

SEQ ID NO: 7131 - DNA, 108 bp, Zea mays
gcaaagcagcctttgccgagtgccagctggttgacactcggcaaagaattgtaaaattatctttgtcgtatttttcacccaggggacactcggcaaagtcgtctttgc

SEQ ID NO: 7132 - DNA, 106 bp, Zea mays
catcggacgtaatgttatatccgacggctatagacggccatcggacataaaagcttatgtccgacggctatcaaacagaccgtcggacataatcttaagtccgacg

SEQ ID NO: 7133 - DNA, 90 bp, Zea mays
aggccaatcccaggtgggagaggcagccagactcgcccaaggccaaccctgggcgggatacgcagtcacgactcgcctgaggccaactcc

SEQ ID NO: 7134 - DNA, 61 bp, Zea mays
aacaagatgtgtgatagtcttttggatgattgtcttgttacatacatcgagagggatattt

SEQ ID NO: 7135 - DNA, 95 bp, Zea mays
gagtccccgacgtcgccggcggcgtgaacgcgttccccccgcgatcctacggcggaggagagcccgagcagtcatcggacagcggccagatcaaa

SEQ ID NO: 7136 - DNA, 108 bp, Zea mays
gcaccggtaaagccttctttgccgagtgttgtggccttggcacttagcaaagaagcaagctttgccgagtgcctcccagagcactcggcaaagaaactgacaaagggc

SEQ ID NO: 7137 - DNA, 203 bp, Zea mays
acctttgtgcttggtcaaccaatccattcctaagatcacatcaatcccttgggatggcaagacagttaagtctgccaagaacactaccccacttaaaaggattctgacttaggagcatttgtgctggcatagaaggtctgaccctgaggtgcgggtgaccaagggaatctctagaggggtagaggggatgccatgctttttca

SEQ ID NO: 7138 - DNA, 156 bp, Zea mays
taaacttaaaagctcagctcaggagtgatccagcacgaccttacttgaacaggatctgttctataggatcgtaccgttgcatccttgattaataaggaggcaagcacttaagcctggttgatgtgtcatgacctttgggccagagcgtgattaacg

SEQ ID NO: 7139 - DNA, 94 bp, Zea mays
tcgcatcatgtcatcgtgccgagccacttcctctaacgtgaagtcggagctgctatgtcaggggatgtggctcggcaacgataacatgaggcga

SEQ ID NO: 7140 - DNA, 71 bp, Zea mays
ggcgagagcgacgtggcgcgatctgattggtctacgtgtcgcgatctgattggtccacgtgtgttagccgt

SEQ ID NO: 7141 - DNA, 152 bp, Zea mays
aatagaacccgccgtccacgccaggattttctgagtcttggaaacacttacaccgagacccctgctgtttcctggaattgatgccccgtccagagcgttataaatcaagactagttaagtgcccgtgcgttgcgacggcacgcaaattattc

SEQ ID NO: 7142 - DNA, 234 bp, Zea mays
tctatatacgtcaccctcctgtatcgtcatcgagcccatcgaaccccgttcttccctgctcaacctcgtcaaaccccgaatcccgaacgttaggcaaaaataagcgaagtccatgtgcatctcttatcaagtgctcgatcaaagacttcaatcgagggtcatcgtcgttccgtacgttatcaagaaatcccaagagatgggcgaagacgaagctagcagcgtgatattcgccaa

SEQ ID NO: 7143 - DNA, 71 bp, Zea mays
taacttcctagaggaggccgtagaaagttagctacccatgctaactttctacgaccgcctctaggaagtta

SEQ ID NO: 7144 - DNA, 161 bp, Zea mays
gagatctggcccgtgtgaagcagaccgcccgctgccgccgacggtacgtagcgatgccgtcctcttcctcttctgttgtcgatacaccgccggtcggcgcgtcattcgaggagacgctgagcaatgtggcggcggaggagttgcgcgccggcgacacagtg

SEQ ID NO: 7145 - DNA, 100 bp, Zea mays
gaaataaaacttatgtccgacggctttcctgctcccctccacggaaataagtttatgtccgacgggcgagctggtagccgtcggacataaggttttttaa

SEQ ID NO: 7146 - DNA, 76 bp, Zea mays
aaagcactttgggccaggctcaccaggtacgagtagattggtcgcatctccagagccaggctcccagtgaaacctg

SEQ ID NO: 7147 - DNA, 148 bp, Zea mays
gaagatgattaaggccttgttcgtttgcatcggattgcaccgaaatcgttccagctaatcaaattttatataaattagagaagcgatcctgttaggaatcgttccgacccaccaatccggcacaaacgaacaagaactaaatctttat

SEQ ID NO: 7148 - DNA, 69 bp, Zea mays
attatgcattccgtgtctatgactggtgggatcatctgtgtctatgatttatagacccgatggcatatt

SEQ ID NO: 7149 - DNA, 247 bp, Zea mays
gtctcgttacctgatgcggtctgggcactaaactacgactgagtgcagggcgactgggttcacccctttccgccttctatatggatcggaggccatgaccccacaagaaataaaacatgggtccccacagacagtcttgtcagctgtccccgacgtggacgaacccacttcgaaggatctcatctgtggcagaaccacccgaattattccagcttaagtgcctaagtcacgcctcaggggccgtaac

SEQ ID NO: 7150 - DNA, 233 bp, Zea mays
tcagtacagctgacactcggtaaagagggagcctttgccgaattcacgcggtgggcactcggcacaggctccgtcgccgtcacctggtgccgtgacggtgacttttctttgccgagcaccgggtgacactcggcaaagtatttaccgagtgcctggcaaaaagtactcgacatataagccgttgccgatgtacaattcgtcgagccttctttgccgagtgtcagacttggcaa

SEQ ID NO: 7151 - DNA, 201 bp, Zea mays
aattggaggcgatactggtgactgttgaataattagacaaattccaaattaaattccgaatataaatcatgaccaaatcagaagaactgaaataaaagccaaatcagatgatgcgtacgtgactctctgaatgtctgccttgttggcgcgcgccaggatcagatgccccttcgtcagcagatcacgagcagtcgcgtgaag

SEQ ID NO: 7152 - DNA, 181 bp, Zea mays
ttggccttgaccgcgggtccctccgccgtggccctagggggataatcttggcggcgaggggcctcaccagcggggtgctggttggcgatgttgtgtacctgctgctggctgcggccgtcccgaccgggttccgtctgtgaaggccttgtccacgtgcggctggactgtggagggtctttgg

SEQ ID NO: 7153 - DNA, 112 bp, Zea mays
ttggttcactacctcagttgccacactttgtctatcttttctgcctaaggttagttattcaattcgaacgactaacccttatgcaaagtgtggcacatttagccacaaaacc

SEQ ID NO: 7154 - DNA, 244 bp, Zea mays
gtccccttggatggctttgttggagaggtgagaaaagttgaggaagtcctggctggcgaggactctcttaagctcgggtcttagtcctttcagaaaacgggcaatcttcctgaactcggtgctgacatcgtcaggcgcgtaacgggccaactctgtgaacttgtgcacatactcactgactgttctcccaccttgagttagctcccgtatctcttcctccttgagttgaactatcccctggggt

SEQ ID NO: 7155 - DNA, 93 bp, Zea mays
gggtattgttgtgagccgtcgcaacgcacggggaaccgactagtatatacttactagtcagttgctcgtgctttgctacggttgttatatata

SEQ ID NO: 7156 - DNA, 179 bp, Zea mays
tggaaaatcacaaaagcccatataagtggatgactaaggaataggtggaaccaatagcaccatattgctagttctagtggagtagagctagcttaaatatggaagccaccactagtacagagaagttttatagtggcggttgtaatcttatttatagtggcgtttttcgtaaccgccag

SEQ ID NO: 7157 - DNA, 74 bp, Zea mays
acttcctacggctgactgtagcccctaggaagtttgctggctaacttcctacggcgcagttggcctctaggaag

SEQ ID NO: 7158 - DNA, 101 bp, Zea mays
cgccgagtatttctttaccgagggtttttgcgtggcactcggcaaagagttctttaccgagtgcccgaataaaacactcggcaaagagccaaattccggta

SEQ ID NO: 7159 - DNA, 81 bp, Zea mays
ctggaaaacgattaggtgctggctgctgctgaggtggcctgatcacccatctgcttgcctgctgctgaaatcctctgctct

SEQ ID NO: 7160 - DNA, 75 bp, Zea mays
tacccttgatgattagtgggttgtcgccagaaagaacggaagttgtatgttgcgtaaccagtgacatggtgggta

SEQ ID NO: 7161 - DNA, 69 bp, Zea mays
cacactcttgggagagctctgtgcgcggttcgtggcgaacttcgccagtgcttatcaacagcacggtgt

SEQ ID NO: 7162 - DNA, 156 bp, Zea mays
agggcgtgagcgtcgacatcttgtaacagaattatttagcacagtggcggacccaggaactgatgacagcctaggcgagaatacggtgtgatccccacgcctgtgctcgtgccacgtgctgcttgcttccgtacaatgtgctcgcgccttgccctc

SEQ ID NO: 7163 - DNA, 182 bp, Zea mays
caactatggcacagacacgtcatgccggcttgctaactgtatcgggccagcccgttagtccgccgatccatttaattaaatcagcgtaaaatgttaaaaaacggtgcatggggtgggattcaaacccatgccctgatggaagaagggcggaagacactgggtgaaactgtctaactagtaga

SEQ ID NO: 7164 - DNA, 204 bp, Zea mays
ccctattaggccttgttcggttacatgggatgaaatcccaccttggatttaatccggatatggattgagtgaatccatatctcacacctaatcccaccatggaattgggtgtgaggtatggattcacccaattcagacccagataaaatccatagtgggatttcatctcttgtaaccgaacaaggcctaaatgggatggcttta

SEQ ID NO: 7165 - DNA, 156 bp, Zea mays
actaagttgggtgtcaaaaacaggtggtggccttccggatcgtacttagggatttgcccgaacttccggtaaaggcaagtaaatacagtggtggttgcgtgggcgcagctatcatcttttaattgcacctattccctgtcattgagtatgcgataa

SEQ ID NO: 7166 - DNA, 92 bp, Zea mays
ttttaaaaaccgtgggtacccacgttctgaaattaagttcgtgggccctatcaaaaaccgtcgaacttaacctattatgaacgtgggtaccc

SEQ ID NO: 7167 - DNA, 120 bp, Zea mays
gaggggcacactcggcaaatactttggcgaggggcacactcggcaaaaactttgacgaggggttttagggtttggcgaggggcacacttggcaaagactttgccgaggggttttcagggt

SEQ ID NO: 7168 - DNA, 78 bp, Zea mays
catgaagcatagagtgactccataaaccaatcacaccataagggggtgcttggtttgaggaatcactccatccagaat

SEQ ID NO: 7169 - DNA, 132 bp, Zea mays
ctcggcaaagacgacctctttgtcgagtgctagcgacataacactcggcaaagaacctaagccggtgcccaggtctgtgctctttaccgagtgttatgacccagacactcggcaaagagtctctttgccgag

SEQ ID NO: 7170 - DNA, 116 bp, Zea mays
gagggccccagttgttgtcagactcccttccctagttttgcactctgacgcgcgggaccctacggtcaggctcatcttccctctttaggctgtctccagcaacgtccactaaattt

SEQ ID NO: 7171 - DNA, 211 bp, Zea mays
atttgaaataaagggtgcgtttggttgaatgtacaaagagggatggaatgagacgaccatgttttctatagtgtttgattgagagttaagcgggagcgaggtgaacaccgaagtgatttttgggggcgacgtgatcccaaaaaatcaaggggcgaaggcgcccccgactcatcctactttgacttcaaaccaaacatacccaaagagtagc

SEQ ID NO: 7172 - DNA, 105 bp, Zea mays
tcggcgcaatagatcttggcgccgagctacccgctgcgttgtcgtccaccagctaacgcggtgccgacgtggcaccgagctcggcgccaagatctatggcgccga

SEQ ID NO: 7173 - DNA, 172 bp, Zea mays
gagagcttgtatgaacttgtgagcgtctgagtgagcctaagattggatctgtcttgtaacgccgcatgcctccccttttatagctgaaggggggcatgagaaaaggtactgaaccccgatatgtgggcccagagacataatgaatatagcgcttggagacatacaaactttg

SEQ ID NO: 7174 - DNA, 146 bp, Zea mays
aaattgaaaaatacttggcgaagtctttgctgagtgacactcgacaaaaaaaaaactcggcaaactgtacatcgacaataacttctttgccgaatactttttatcgggcactcgacaaagactttgccgagtgtcagccggtactc

SEQ ID NO: 7175 - DNA, 98 bp, Zea mays
gggacaggagccgaccgtgcgcggcgcgcgcgcagagggcagccagtgcgcgaccgagcgcttgagcacgcgatcgaacacgtggaggtgtgtttctg

SEQ ID NO: 7176 - DNA, 126 bp, Zea mays
ggcctgtttggattgatgtctaacttgccgcactttgcctaacttttctagctaaggttagttattcaattcgaacgactaaccttaggcaaaatgtgacacagttagccacaaaccaaacatgct

SEQ ID NO: 7177 - DNA, 95 bp, Zea mays
tgttgtatttgtgacactcggcaaagagtcttttgccgagtgtcaaaaaaagacactcgggcaagaaactctttgccgagtgtccaaaaataaaa

SEQ ID NO: 7178 - DNA, 79 bp, Zea mays
aatcccgggaccctgttgtgagtggcccagaccccacacagaggggtccgggacccatccaaggggtccggttcgtgcc

SEQ ID NO: 7179 - DNA, 78 bp, Zea mays
gtgccatataaagcactcggcaaagaacctgacatggggacccgctgacggattttttgtcgagtgctggacggcaga

SEQ ID NO: 7180 - DNA, 173 bp, Zea mays
tagcccctatcacatcgaatgtttgaacctccgttcggggtattaaatatagtcgaattataaaactaatttctcagccgaagattaaaaagtgagacgaatctagtacagttggttgggtctatatttcatactcctatttgaaagtcaaacgcttgatatgacccgagcta

SEQ ID NO: 7181 - DNA, 237 bp, Zea mays
cagttccgtacccccccccccccccccaaaaaaaaaatcaacgcacgccgtacacgcatagcatataggcataaatctaaagagaccgcgcaaaaacacctgcatgtccaaaccagtcaactaatcacgcgattattgcagcgcaaaagcgcgaccccataggaaggacgacggaagcagccgcacaaagcaagcgaaagcagaggccatggcccatgggggggggggggggggggg

SEQ ID NO: 7182 - DNA, 159 bp, Zea mays
agttatccccgcagtccacggagttgtggaacgcgccaatggaaaaatttattctgtggtgcaatagatgctcctcgacgaaaaaagggtgccgggcgggatttgttacccgaggcggtctgggcgctaaacacgactgagtgcagtgcgaccgggttc

SEQ ID NO: 7183 - DNA, 114 bp, Zea mays
ctagctcggcgccaagatctatgacgctgatctactgccgtgtaggtgccaacgcagcagaggaagtccagcgcaccacgtagatcgacgtcatagattatggcaccgagccgt

SEQ ID NO: 7184 - DNA, 133 bp, Zea mays
gaggtaacacggctcggtgccataatctatgacgtcgatctacgtggtgcgctggacttcctctgctgcgttggcacctacacggcagtagatcagcgtcatagatcttggcgccgagctagcaattccttcc

SEQ ID NO: 7185 - DNA, 72 bp, Zea mays
aagaaaaagtcaagtccgactcaactttgcctccacctcggagtcaaggaccagtctgcactaaaacgaacg

SEQ ID NO: 7186 - DNA, 83 bp, Zea mays
tgaatttaggggaagctcctggagactgagaaaaaatagaggacagaatcttcagcagcgtcccctaaattcggtccgctaaa

SEQ ID NO: 7187 - DNA, 67 bp, Zea mays
gatttttttttttttttttttttttttttttttcgcgcgagagagagagacagacagacagagagag

SEQ ID NO: 7188 - DNA, 92 bp, Zea mays
gggttaggcgccatagatcttggcgcctaccccctgtacacgtggacatacggtttacagagatagactccaagatctatggcgcctacccc

SEQ ID NO: 7189 - DNA, 105 bp, Zea mays
ttgtttggggtaggcgccatagatcttggagtctatctctgtaaaccgtatgtccacgtgtacagggggtaggcgccaagatctatggcgcctaacccctttaaa

SEQ ID NO: 7190 - DNA, 176 bp, Zea mays
gaaggctccccacaagacgccggtactgtgtagcatccacctcctccgtcgcgctgtcgcgactcagcttcagcctctcctccatcggagtgagagctgggttgcattcggtgagcccagccagctcaacaatgcgcttggcgtaggcggtctggcgaagtgtgatcccggagtct

SEQ ID NO: 7191 - DNA, 115 bp, Zea mays
ttaccgaacgcaggactttgccgagtgcggcgctcgacaaagtgggctttgccgagtgcccgataaaaagcactcggcaaagacgccggcactcggcaaagagccgaattccggt

SEQ ID NO: 7192 - DNA, 120 bp, Zea mays
gttaagtcactttctttgccgagtgcccgcgatccggggctcggtaaagattttttttaaatttaaaaataaactttgttgagtgccggatcacgggcactcggcaaaggctgctttgcc

SEQ ID NO: 7193 - DNA, 203 bp, Zea mays
tccacatcctagcttggcaccaagatctgtggcaccgagctaggtgtcacgtcggttgccaccttgacccgtccacgccagtggagcaggcaccttggcaccatgggtcatcgcctagctttgtatcgttgttctctcttctcgatcgtagtgccacatcctatctcggcgccaagatctgtggcgccaagctaggtgtcacg

SEQ ID NO: 7194 - DNA, 195 bp, Zea mays
acacctagcttggcgccacagatcttggcgccgagataggatgtggcactacgatcgagaagagagaacaacgatacaaagctaggcgatgacccatggtgccaaggtgcctgctccactggcgtggacgggtcaaggtggcaaccgacgtgacacctagctcggtgccacagatcttggtgccaagctaggatg

SEQ ID NO: 7195 - DNA, 79 bp, Zea mays
caccagctgacgccgaatgccgtggtggccctggcaaaatatgtctgggcaacgacttcatacggcgggcaaccctcgg

SEQ ID NO: 7196 - DNA, 97 bp, Zea mays
gcctaggtatggggccgtcggacataagcgctattaccgagaagcccggtggcggccgtcggacataaggttatgtccgatgaccctgtacgaggcc

SEQ ID NO: 7197 - DNA, 178 bp, Zea mays
aatagggcagcctgaagggcgcggcactattaggtattagtgtcgtatagtgccggcacgacacgattagacactataatgttgtgtctgggccgctgattaggcactagtaccagcatagtacgacataattactaatagtgactaatagtgccgtgcctaatagtgctagtgctct

SEQ ID NO: 7198 - DNA, 121 bp, Zea mays
tggacttgatcggtagggacctggtcggccgttcggcctcgcagacttgcttgttgtggggacttgatcgatcgctgcgcatcgcggacttgctcgacaaggacctaatcggtcgctctgt

SEQ ID NO: 7199 - DNA, 240 bp, Zea mays
taggaatcgttccgacccaccaatccataacaaccgaacggcgccttagtgttttgtgtttgctaggtttattggttgtagaaacacagatcgagtttggttactccctagtgagttgcttctttcattatatttatgtttctttcattcactatagcatccctgatttttgccattaaaaagattgtctcgttgattatgattgccactaagtctatgaattgtgggtccatctgagtc

SEQ ID NO: 7200 - DNA, 97 bp, Zea mays
atatacctcccaagttattgggcccacatgcttctgcccttgtctccagactcttgttattgggtccgcatgtgcaccagataacttaacaggatcc

SEQ ID NO: 7201 - DNA, 163 bp, Zea mays
gagcaacgctctggcatgtgtctgggaagcggtgcccgatgaaggtaatttggaaaggagggtggtttgggtagttccggctttctcccaggtagactgccatagagcacttttccattccattttcacggtactccttccagacatattcgggcttcttgcg

SEQ ID NO: 7202 - DNA, 159 bp, Zea mays
agatggatatgtaagtgaatcagataacttacccgggtaccgaaccatttggattatgaatccgagtggattctaaacagagtaaatatggcacgagtgaccgctgacaggtggtgtcacaacccaaccaagttattgggcccacgtacattaattctt

SEQ ID NO: 7203 - DNA, 185 bp, Zea mays
gtcggacatacgcttatgtccgacggccagggggcgaaccgtcggacataagcgtttgtccgacggccagtcgtacagccgtcggctatatattgctattttcgacggccgctgctggccgtcggacataaccttatgtccgacggttgcctacggggccgtcggacataagacgaccgtcggaa

SEQ ID NO: 7204 - DNA, 172 bp, Zea mays
gtcgctaatgaatcggggtggagcgtaaaaaactgaaccctagcacttcgggtcctgttttatagacgtccggacctggtccgactcgaccggattgcaccgtccggcctgagcttcctctctctctctttatatatatatatagtttgcgccacacccacgtaccaacaat

SEQ ID NO: 7205 - DNA, 82 bp, Zea mays
acttgatgcttccaatcaggatctcggtagaagtcgggacattaacgaccactcgcgcgaggtcaggaattgattgtattca

SEQ ID NO: 7206 - DNA, 94 bp, Zea mays
cggccccacgggtatactggcccattctgagcccaacttacgcgtggaaactcgcccgaccttcagacgtagggcggctatccccgagtcccga

SEQ ID NO: 7207 - DNA, 164 bp, Zea mays
gatcggaaattgaagcagccggccagccgcccggccaccagcggcccgggaacagtcagcagtggtggtgcctgcctacccggcctgcagcgcacacacgctagcttgctctctcacgcacgccactccgatggagctgagctggttcctgtcagctttcctct

SEQ ID NO: 7208 - DNA, 99 bp, Zea mays
attatcttcccaagttattgggtccacatgtactctgcccttgtctcaaagacccttgttattgggtccgcatgtgcaccagataacttaacaggatcc

SEQ ID NO: 7209 - DNA, 104 bp, Zea mays
cggcttggcgggggccgtcggacataaggctctattatgtccgacgacctgagtgaagccgtcagacataagaaagtcttatgtctaatggccccgctaagccg

SEQ ID NO: 7210 - DNA, 106 bp, Zea mays
tagtctggagaggcgtcctcagcgacggactcgggctcaagttctctggaaagggacgcctgggagggtgagagctccgtccgggctcgggaccctgtcgcaccac

SEQ ID NO: 7211 - DNA, 194 bp, Zea mays
actagctggatgcccgtgcgttgcaacgagaatatataataccagtatactacgataacttatatacaaaatctatgttatatttttatgagaaaatgtttcataatcaatttgtgatcctagacatacataaattttgttattttaatctagttatttcaccactacattgcaaccatcagtatcatgcagac

SEQ ID NO: 7212 - DNA, 82 bp, Zea mays
atcctgtgccgagtgtccagtactcggtaaagaggctctttgtcgagagcctaactttaccgagtgcggctctcggcaaagc

SEQ ID NO: 7213 - DNA, 168 bp, Zea mays
ttaatgtttagttcgcctctgtgtctttgtatatcttgtgctactttgtgctcctttcattatattcatacatacgcatatggcatctcatttaggatcgagagatgacgatcgtgcaagtgatgtggtgccaaccacaagatgcagttggtggacgacctgaagaat

SEQ ID NO: 7214 - DNA, 148 bp, Zea mays
aaggacatgtccaagaggaggaccaggagcaggcttcagaggctgctattgaggatctccccccattcccccagcaattgaaggcaagccccggttttatgcataaccgtattattatatgctacttttctatctcttaatgcttgta

SEQ ID NO: 7215 - DNA, 197 bp, Zea mays
tgtactgagccctgacatgtgggcccatgaacatatcagatgtattacttgtctcaactaatgttcgctgctggagcaatcttcttgcgtcatgacatccgagatctgtgtagtattggcgtgcacgggaagcttctcgtataagtgatgatggatacagtgcaccgcgctgcatgggcgcactgtttgacaatggt

SEQ ID NO: 7216 - DNA, 82 bp, Zea mays
cgagctcgtcgccgtttgcccgtgcgcagcgagtccgcggccgcccactccctctgccaccgtagaccggccagtggagcca

SEQ ID NO: 7217 - DNA, 167 bp, Zea mays
aaaacaaaaatcccgtaagggccctgtttctttcttcaggatgaacctggatttcattcccagctcatcaaaatttatataaaatagagaagtaatccggctaggaactattccaaggctccaatccgtgaaatccgaacagggcctaaggggagtcgaaacctaga

SEQ ID NO: 7218 - DNA, 94 bp, Zea mays
cgcacgcagggcctcggtttgctgcgtggactgtctatgcatttcctacagagtgtaatggaacccagctcagctccgccgagccaaaaggaaa

SEQ ID NO: 7219 - DNA, 101 bp, Zea mays
ccaccgggttggacggtcgagtgggatggagcacgaggagtagtgggctaggccttgcccaattcctcgataccgacgacatcgattatccgctgcacttt

SEQ ID NO: 7220 - DNA, 80 bp, Zea mays
tagattgcaatctcgtcgatggagagtacgtgctcatccctgagcaaggagctgtccacgaggaagaccaggagcaagct

SEQ ID NO: 7221 - DNA, 88 bp, Zea mays
ggcccactggtgccccctttgccgagagctagtccaacaggcagttggcaatgagggagcactcggcaaagggaccgacaaaggggct

SEQ ID NO: 7222 - DNA, 84 bp, Zea mays
cgagtccagggctggaaggcactcgtattctctcgccctttttggactgacgtctggtgcgggtgcctctcggtttggagctgc

SEQ ID NO: 7223 - DNA, 124 bp, Zea mays
agttttatttgtcaggttgcactagttatcgttgcttgtagcaagttatcttggcttcttcgaagctagttatctgaagattgatcctacgtcgtgaagatcgggcatcgtgacacatcatctg

SEQ ID NO: 7224 - DNA, 144 bp, Zea mays
cggaaacaacttctttactgagtgtctgaagcactcggcaaagcctgaaaaacactcgacaaagaaggctcggcgaactgtacatcagtaacgtcttctttatcgagtacttttatcgggcactcggcaaagaaaagtcgttgt

SEQ ID NO: 7225 - DNA, 100 bp, Zea mays
agggctgtcagagcggccgtcggacataagcttatgtccgacggctgtcaggtagaccgtcggacataagcttatgtccgacggtcttctagtgggccgt

SEQ ID NO: 7226 - DNA, 123 bp, Zea mays
ctactatctatccaacattgtttctatcaaattttacttggaaaatcgatggtatttatattttattgattcctctgtgtttttacagcctccgataccagctgtggcggaactgcccgactt

SEQ ID NO: 7227 - DNA, 106 bp, Zea mays
gaaaaaacaaatattttttgtcgagtgtcaaggaaatacactcggcaaaacaactatttgacgagtgtttgccaggtgacactcgacaaagaatataatttgccga

SEQ ID NO: 7228 - DNA, 196 bp, Zea mays
ttaggatgcgttggttgcaatgacaggacaggacaggatgggacgatccctcaaataaggttgtttggtttaggatcaagggttgggacaagactatcccaatgttgtctccagttatccctcaaaattggagggacgagagaggacgccaagagacgtccttgtcctggttgtcctgcaaccaaacgcacaatta

SEQ ID NO: 7229 - DNA, 78 bp, Zea mays
ttacctggaccgttgcagcgatggcggccagatctggagtccaaaacggcggccgctgtcgccggagccgtgggtggg

SEQ ID NO: 7230 - DNA, 81 bp, Zea mays
tcgatggcaggttctggtgctggatcttgggctacctcctgaggaactccttgctccggcacgaggatgtactctccgtca

SEQ ID NO: 7231 - DNA, 138 bp, Zea mays
ttggatacgcgcttggatcacgtctctgtggatgcaagaaaagatgtataatttggctatgattgcaccagcacatccaggccctgtttgttccgtacaggcaagcaaacacaggatgaggtctggtcaatgcatgta

SEQ ID NO: 7232 - DNA, 150 bp, Zea mays
tgaagcttttagggcatgtttggttcgttacctcaattgccacactttgtccaacttttctgcctaaggttagttattcaattcgaacgactaaccttaggcaaagtgagcagttagccacaaaccaaacaagcccttactctgttttaa

SEQ ID NO: 7233 - DNA, 81 bp, Zea mays
tgccattgcatgagctcggcctgcacgaggagctacgtgtttggcggccgtctcggacgggcctggctgcgggtgatattt

SEQ ID NO: 7234 - DNA, 100 bp, Zea mays
gtgctctacagctagcactcggcaaaggcgacttttgccgagtgcctgagatccagcactcgggaaaaggcgactttgccgagtgctagctgtagagcac

SEQ ID NO: 7235 - DNA, 100 bp, Zea mays
gtgctctacagctagcactcggcaaagtcgccttttcccgagtgctggatctcaggcactcggcaaaagtcgcctttgccgagtgctagctgtagagcac

SEQ ID NO: 7236 - DNA, 140 bp, Zea mays
gcgcgtggatctgggatttggacgttgttgcccctagtaattgcacaaaaaaagatgcatttaagaggaattgaacttgagacctccagtctagaatgctttggaactgctgcagcaaccaatcaagcctgattgtttta

SEQ ID NO: 7237 - DNA, 120 bp, Zea mays
aagaatacatgaagctgctgggtggcgaagcggaccttggccacattggaacaacctccattaagtagtgggaatttggataccaccaccctgagccacacatcagcatcaagtgggtcc

SEQ ID NO: 7238 - DNA, 168 bp, Zea mays
atatagagtacgttgctgggcgcgttgaggacgtgtctgaaccctatattaagggtaccggacggtttaccgtcccttgctggacacaacctaaatggtttaccaagacaaattttaattattcggcatcaaaataactctccaacaggctagctaacttactcacca

SEQ ID NO: 7239 - DNA, 175 bp, Zea mays
acacataacatggctcacacggttacaccacatgggatcatccttcttctcagcacgcaagagtcccaagggaaaataagacatctccaggggatggtagccacagaaagtcgtcagagtcttcatggctgctgcttcaacggtgtcgtccgtcctgagtccaatcgtctcagag

SEQ ID NO: 7240 - DNA, 173 bp, Zea mays
cactactaggtgagtgctcgtgcgtcacaggcccgagtttctcttcaacgtcatcccgacggctcgtggatgtcgtcctccatctcataacagtataacacacatttgtatatataagttatcgagctattatatgatcccgttgcaacgcacgggcactgagctagttatcc

SEQ ID NO: 7241 - DNA, 177 bp, Zea mays
tcggaaacgggccctttgccgagtgcccgaaacactcggcaaagctttaaaaacactcgtcaaaagctttgccgagtgtgacactcgacaaacaaggctcgacaaacagtacatcgacaaagtcttctttgccgagtactttttctcaggcactcggcaaagaggcttgccgagtgc

SEQ ID NO: 7242 - DNA, 108 bp, Zea mays
tttggtgacagcaaacgaccttcgggctggggacgtctgcgagcttgttaaggggccagacgatggtgagccgatgtactatgtccggatgtgtgcgcttctcttctc

SEQ ID NO: 7243 - DNA, 119 bp, Zea mays
ctttttgagccagcacgagcacgacccgaaaacaagagcccaaagcacggcccggcacaaaataatatgggccgagctagcacggctcgaagacgggtctaggtcgggcctcaaattcc

SEQ ID NO: 7244 - DNA, 132 bp, Zea mays
cagccaccgcggttggtcacctggctgctctgatccgtcagtcaagactcagcactcgcccttcaccactcccggtccatcagcacgagcccacatgaccttcacctcagccatcgaccaccgttcctgtgc

SEQ ID NO: 7245 - DNA, 118 bp, Zea mays
cgacaaagacttctttgccgagtgccggatctagagcactcggcaaagcatattttaaattttaaaaaaatatttgccgagtgccagatcgagagcacttggcaaagacgttacatat

SEQ ID NO: 7246 - DNA, 175 bp, Zea mays
cagaatctcgctctttgccgagtgccagatgatttgacgagtgctttttttcgagcactcgacaaacaagttctttgtctagtgctaaacaaaaaacgctcggtaaaaaacactcggcaaagagtttctttgccgagtgttttatttttgacacccggtaaagagcttctttgct

SEQ ID NO: 7247 - DNA, 138 bp, Zea mays
ttagacttagtgggccgttcgcgtatggtggcaggtggcagcccagtactctatactgtacctgagttgttgaacgggccggtttaaaggcccggtcaataacgggccgtgctcgggctagcccaacgggctcaaatg

SEQ ID NO: 7248 - DNA, 116 bp, Zea mays
gcaggaactctgcaggcacgcacctcacatctgcgcgcgtgcaagtaaatgacagaaaaatcacatacactacatctgcgcgtacaagctgagctcgtgctatgcagttaaccctc

SEQ ID NO: 7249 - DNA, 247 bp, Zea mays
ggggcctctacgcccgtagcggtggcctccaaaaggccccctacgcgttgcagcgttaggggaggccgcgccgctcctcagatcaaggggagcactgttacacctcattgcatattgctcctctattcaatatttaaaaaaatagtaataaaagatgaatagagttagataataatattttatagttgtagtggggtatatatagggaataatataggggaaccgctgcgggagatgaaaagttagg

SEQ ID NO: 7250 - DNA, 140 bp, Zea mays
agagagtaggtgcgtttggttgcgggtcagctaggacaggaacgtcccctgacgttctctcttgtccctccaattttgagggacaacactgggatagttctgtctcaacccttgacccagaaccaaacaacctaatttga

SEQ ID NO: 7251 - DNA, 167 bp, Zea mays
tactaggtgagtgctcgtgcgtcacaggcccgagtttctcttcaatgtcatcccggacggatcgtggatgtcatcctccatctcataacagtataacacacatttgtatatataagttatcgagctattatatgactctgttgcaacgcacgggcactgacctagtt

SEQ ID NO: 7252 - DNA, 78 bp, Zea mays
cgctacatatgcacgtctatttggtctttgtttgcgttaaacgtagtcgaactcgaggtggcgccgctacctgtagcg

SEQ ID NO: 7253 - DNA, 83 bp, Zea mays
gctatgaaagtcggcgtcgtcgtgctcagggaggctggcgtcgttgcgggcaaggagcccgacgtctgctcgacgatggaggg

SEQ ID NO: 7254 - DNA, 188 bp, Zea mays
ttgctgacggttctttgccgagtgccgtgtttcgccgagagcttgacattcggcaaagactcctttgccgagtgtctttctatgccgagtgttttaccctcggtaaactaggtctgtgtcgagagtcttagttcgcaaaaagtggcactcgataaagcgccgagcactcgccaaagaacctgattgcg

SEQ ID NO: 7255 - DNA, 221 bp, Zea mays
aaatgtagcaaagcacgagcaactggctagttaatgatgatgttctatccaaatcattctctggctttctgtccttcaacatggcaagggtatatatcctattttatccaaaaagcttatttgtcaaggtactgttactagatcaagagcaagtgaattgtccaggtttctatgtatgggatatcaaggtacgactttgtcagttgtcgtggactcgtggt

SEQ ID NO: 7256 - DNA, 81 bp, Zea mays
ggttgtcgatgttccaggagtgctccaggtcctcgccatttggcgttgtgagcctgtaggcgctgggggaagcttttgttt

SEQ ID NO: 7257 - DNA, 95 bp, Zea mays
cgagtgtcacctgggacactcggtaaagacgctgtctccgtcacccgacgccgtaacagctgtttttctttgccgagtgcacgagaaaaagtact

SEQ ID NO: 7258 - DNA, 100 bp, Zea mays
cccccctctcccttaaccagtagccgcagcggagaaaagggcggaggggcttcccgccggcgatattgctccggtgaagtggtcgaggacgaaggggagg

SEQ ID NO: 7259 - DNA, 81 bp, Zea mays
gcggcggcgcggcgattccacggctaggttcacgttcacgacttcacgagctgggctatgcctgtgatcctgtgccggctc

SEQ ID NO: 7260 - DNA, 156 bp, Zea mays
agccaaatctcgggcactcggcaaagatctgatttgctgagtgttgctctcggcaaacaggaacacctgacaaatacaacctttaccgagagacaaatgctcgacataaaaatacactcgacaaagatatctttgccgagtgtccgactctcgaca

SEQ ID NO: 7261 - DNA, 198 bp, Zea mays
aggaggctgccgaggctgaggccgagctgctccgggctcaacttgccgagtccgatggtcgcgtggttggtaaggcccttaccccttgttccttgtcgtcctcggcatctcccttacttttatcgttttttacgacaactttggaagtcgaactggaggagctacgctgctgcttgggtcgggccttggacttcgtcg

SEQ ID NO: 7262 - DNA, 146 bp, Zea mays
tctcgtagcaagcaaaacgcttaggcccctcctctctttaggatttagggcgggtgcaatccgccacctggccggggagatttcctccccgacatttggcgcgtcaggtaggggggctaggcttcaagtttttgttagctacctgt

SEQ ID NO: 7263 - DNA, 136 bp, Zea mays
tcgacaatttgacactcggcaaagaagctttttgccgagtgttatatttttgacactcggcaaagaagctttttgacgagtgttaaaaataaaacactcaaggaaagagcttctttgctgagtgttttcttttacc

SEQ ID NO: 7264 - DNA, 143 bp, Zea mays
gcgcaagagtgaggacaaagtgcgcacaaaagactcgtgttggtctgtgaggacaatatatgatcctaaagagctgtcaggagtaagtatccctggtccaaggattggacggggtgtgttacattgatcactcctctttacct

SEQ ID NO: 7265 - DNA, 156 bp, Zea mays
atttagagccgaccctcgcggtttcacgggcgtgtgtgggttagggggttcgggtatatggcgcatggcgcatgtggggcccagagtgggtcacatggcatgggcatatgaccgacacctagacacacagacgtgggctaagaggggagggttcct

SEQ ID NO: 7266 - DNA, 90 bp, Zea mays
gacttcttcttcgtccgctgcgaatgcgctgttgggcgaatcgtcatccgaggataccatgagcgatttggcggcggtggagttacacct

SEQ ID NO: 7267 - DNA, 176 bp, Zea mays
ggaactccaagcagcggtgcggcttcaggcggcagcgcgaggttttctgtctcgccgccaggtacagtcccttcgtggatataagcaccttattgtggcctccagggccaccccatggccatcatcacatgagcaagtcgtggtgcgcctgcaagccgcagtgtgcgtcttccttg

SEQ ID NO: 7268 - DNA, 117 bp, Zea mays
cggaattcggctctttgccgagtgccaaatgttttgtcgagtattttttcggtcactcggcaaaaaaacttttgccgagtgttttatttttgacactcggcaaagagttttttaccg

SEQ ID NO: 7269 - DNA, 163 bp, Zea mays
actgtcgtcttgctgggttgctcggcgagcaggttggtcgacagccccacctcgctgggttgcttggcgaacagattggtcggtagccccgcctcgttgggttgatcggtggtcaggttggtcggccgccccgcctcgctgggttgctcagcagtatttgttc

SEQ ID NO: 7270 - DNA, 100 bp, Zea mays
gtgtttttttcaggcactcggcaaagaagttctctattgagtgtaaaaacagtcggcaaaatttgttggcaacatttgtttgttgagtgtactttttcga

SEQ ID NO: 7271 - DNA, 158 bp, Zea mays
gaccgtccaacccggtggcagggtggtaggccaagtcacaccgtctatcatttcctgaatggtacctgcaaaattgtgccacaagcaaggctgagtatactaatactcagctagacttaaccggtgtgaggagtctacttcctctacctctagactat

SEQ ID NO: 7272 - DNA, 84 bp, Zea mays
gtcgaagcagtggacggggggtgggtgggggcggcctcgcagctggacatggccaccacctgctgcttgaccgactgccagcta

SEQ ID NO: 7273 - DNA, 154 bp, Zea mays
ggccgtcggacatacggttatgtccgacggctgtcacacgggccgtcggacataagcttatgtccgacggctagtctgacacccgtcgacgtatttattattattttcgacggcagtccttggcacgtcggacataaccttatgtccgacagga

SEQ ID NO: 7274 - DNA, 157 bp, Zea mays
gggcggcatgcctcgtgtcaagcggtcagacacgtctgtgaatttaggaaaacaacatctccaaacatccgcatagtcttcgggccacgattggcccttttagaaattggtatgttgacatgtgattgtactgacccttgccaccggcgcaccccga

SEQ ID NO: 7275 - DNA, 85 bp, Zea mays
tgggtccaaggctaggaagacactcgcattctctcacccttctcggactgatgcctggtgcgggtgcctcttggtttagagctgc

SEQ ID NO: 7276 - DNA, 108 bp, Zea mays
tttccccgtcgcggtctctacggtccaaggtgacctccacggtctgcgccgccaccattcgctctgcctccatggtctccacggtctgagccgccagcatcgaggggg

SEQ ID NO: 7277 - DNA, 92 bp, Zea mays
gaaccagatcgccgtgatttggtcggcacacccgccgccgacgaggacaccctcctgcgcacgtggaccgagcgattccggccatccccgcc

SEQ ID NO: 7278 - DNA, 85 bp, Zea mays
ggttgtcgatgttccaggagtgctccaagtcctcaccgcttggcctttgtgagccttgtaagcactgtggggaacttttgtcttg

SEQ ID NO: 7279 - DNA, 153 bp, Zea mays
acggacagacgacgacgacgacgacgcgccccggcacggttggtctcgtgcggctggctaccgaagctagctagtaggtccgtgggttgggttccagtcggacatgccgacatgggagccgggagggcttcgtcgtcttttgcgttgcattgc

SEQ ID NO: 7280 - DNA, 227 bp, Zea mays
cgactaatatgcaaacaaccattaggtgcaagcagacatcttatcctgttagatatagatccaactgtagatgttataccttgttgttatgttttttattatgaagctacactaggtgatggtggaagggtttaattgctaaatataacacgcagtttgatctagatctaacgaaccaggatacctgcttgcacgcttgcacctaatggttgcttgcatattagtgg

SEQ ID NO: 7281 - DNA, 79 bp, Zea mays
agaggggttgtgtttccgcgcatgcaggctacccagtgaaaaaacaccaacgctgcatgtgcgggagcaggcggtagag

SEQ ID NO: 7282 - DNA, 84 bp, Zea mays
gcgggtggtatcgcctcgctctcgcccgcgctggagtgcccttccgggcgagaggcgggcgagagggaggcgaggcactggcgg

SEQ ID NO: 7283 - DNA, 86 bp, Zea mays
cgccagtgcctcgcctccctctcgcccgcctctcgcccggaagggcactccagcgcgggcgagagcgaggcgataccacccgctct

SEQ ID NO: 7284 - DNA, 94 bp, Zea mays
tcgatttgggtctgtatctgagttttttgattttactgactctgggagctcggttgagtggagtgaggagtcgtcggaggaggacttggattat

SEQ ID NO: 7285 - DNA, 179 bp, Zea mays
gcagggataagtcttcgtggtgaggtcattcatgtgtcacgggtgataaccaacagagccatggtgtagtgattgcgaggaaccgttcgctcggtgccttggatcatcaacgtcgagatctccattcaatcaaattatcgcatctcacggaagatcgggccgcgtctactatcactttc

SEQ ID NO: 7286 - DNA, 131 bp, Zea mays
gctgctcgttgtctgccattcaagctggttccatcgataaagggatatactgttagtgtgatatatcacttcttctgtagtgtatccctccatgattgaaccctctgggtgagcgcgatttcgcacataac

SEQ ID NO: 7287 - DNA, 118 bp, Zea mays
gtacgcgaacgtcggatagttcgatcatgcgctagaccttatggaggagacgaagtgaagcccaaggaaggaagagaattttaccgcctgattggatgaccgcacccacgtgtataat

SEQ ID NO: 7288 - DNA, 239 bp, Zea mays
ctgacatggtaggggcgagagtggaggcgagagctgacatggtaggggcgagagggaggctgtacactggactcagcctaagtgctcgcgcctccaccggagaacgctcaagcgctagctggcttccgctagcccgctccaccactaggacgaagctccactacttcaggcttcaacccaccatcgactcgtcgtgccctcggtgctgccctcgcccgcctcgcgccccctgacccagg

SEQ ID NO: 7289 - DNA, 143 bp, Zea mays
tctgctgccgctacgccgccgattgacgcgtcatctgaggacacgctgagcactgtggcggcgaaggagctgcgcgccggcgacacggtggatttcggtgtgtcgcggatgtcctcggtccgcgtgcaagatatgcagcagct

SEQ ID NO: 7290 - DNA, 113 bp, Zea mays
ctgcacccttaggcgacttttgctcggacgcatcttcgttgaaggcttctctccctgtaaatagtatcgtgcacttattgtgcttctgtccggctgaatcccttaggtgactt

SEQ ID NO: 7291 - DNA, 169 bp, Zea mays
actatcgtatttaaggcatgtttggttcgttacctcaattgccatattttacctaacttttctgcctaaggttagttattcaatttgaacgactaaccttaggcagaaaagttaggcaaaatgtgacaattgaggtagtgaaccaaacaggcccttagtcataaaccaa

SEQ ID NO: 7292 - DNA, 138 bp, Zea mays
attaagagatggactaggcaggcttttgcttcgggaggcagtgtcttgtcttccctcattgacgtcgaactccgtggtatccctgctcacctttggggactggagacagcggaggttttgcttggtccatactgcctg

SEQ ID NO: 7293 - DNA, 119 bp, Zea mays
ggcagtccttacaagccccgactcttcgctacccctgttgctctatgttgcggcttcgccacatgcggtcagcgcggcactggtgcaggagcagacagttgagggcgtgatcaggcagt

SEQ ID NO: 7294 - DNA, 107 bp, Zea mays
tctttgccgtgtgtctgagacacacggcaaaggctattttacactcggcaaatgctttgccgagtgtaacatagcctttgcagtgtgtctcagacacacggtaaaga

SEQ ID NO: 7295 - DNA, 169 bp, Zea mays
gaatgcgggtaactgttgttcctttgctgtgagccaggctatgcgcgtgcgagatctgtgtttggttgcctgcatgcagatttggatccaagctcgcacgatcctcaaagcaccatgagccaggctcaccagatacgagcagattggtcgcatctctagagccagcctt

SEQ ID NO: 7296 - DNA, 117 bp, Zea mays
cactgttcatcaccctaaacactgtgctgtgggtccacgattaattgttagtagataaaaaattgatagttgatatagaaaatgacattttatagttgtagtggggtataggggagt

SEQ ID NO: 7297 - DNA, 72 bp, Zea mays
acatcattggatcattggcgggtggctgagagtctgacaagagactgactttccttggtggtctgtgagaag

SEQ ID NO: 7298 - DNA, 94 bp, Zea mays
agggggctcaccagcggggtgctggttgggcgatgttgtggaacctgctgctgattgcggctatccccgaccggagtctggctgcgaagtcctc

SEQ ID NO: 7299 - DNA, 79 bp, Zea mays
ctggtggttgggcgcgcaggctgcgagttgctgcagcgatgagctgatcagcaagtgcagcttccgcaccacccgccta

SEQ ID NO: 7300 - DNA, 82 bp, Zea mays
aatgtcacgtggggagtttggctggggcggcacatctgttaaaagataacgcaagtgtcctaagatgagctcaacgagaaca

SEQ ID NO: 7301 - DNA, 78 bp, Zea mays
taaaaccgtcggacataggttgatgccgtcggacataggttatctccgacggttcaatccttatgtccgacggctttg

SEQ ID NO: 7302 - DNA, 97 bp, Zea mays
tggcaggcggcgccagggccaccctgcagatggcgcacctgtccagtccgttgccgaaacagtgcgcctatgctgcgcggtgcactgtactcatccc

SEQ ID NO: 7303 - DNA, 76 bp, Zea mays
ggcgcgccgcctgacaagcgatgtgccgcctcggcatttaatgaggcctgcccactctgctgttaggcggcgacct

SEQ ID NO: 7304 - DNA, 74 bp, Zea mays
acaagcggatttgttacccgtaggcagtctaggcactaaacatgactgagtgcagggcgaccagatttaccccc

SEQ ID NO: 7305 - DNA, 212 bp, Zea mays
gcaacgtcgactggattaaagccgcagcgaacatgatgcattcatttttatttatcaatcagaatagcaaatcaaatagcgtacttggttattactccctccaaaaaattttagttgatgtatgttagtgtaaaaatatactacacagcgtcaaataataaaaacggaggtagtattatttttatttgttaggctttactccgtatctattc

SEQ ID NO: 7306 - DNA, 80 bp, Zea mays
agtcttgcctcgctgggttactcagcgggcaggttgctcgggcagccctgcctcgctgggttgctcagcgggcaggttgg

SEQ ID NO: 7307 - DNA, 103 bp, Zea mays
gacatgccccgatgagtaggagggcgcggcggccgccgcaaaacccggggggcgagccctaggagaacggccgtcggtgcagatcttggtgatagtaattgtt

SEQ ID NO: 7308 - DNA, 126 bp, Zea mays
ggtaaagaatctttttgccgagtaccaagcaaaaaaccctcagtaaaaaaaaatactcgacaaagaaaatctttgtctcttagccgagtgttttatttttgacactcggcaaaaagtttctttgcc

SEQ ID NO: 7309 - DNA, 165 bp, Zea mays
gcgctggactctcatgtgcgctgacgcctatgtggccgagctcggcgctatgaatcatggcgctgagctgctatctccagccgacgagttttccttgcttctgaatttgtacgtgacaggggtaaaaacgttcacatggcgtgcatgggcatgaggccgctgggc

SEQ ID NO: 7310 - DNA, 218 bp, Zea mays
tgggttattgcttccgcaggagaggaccaggaggagtagcgtggccaggcttcgccatgttactcggttatatcagatagatatttccgctgcattaaaatttatggttattatttctgaaactccgataatgtaatcactaatgatactccttaaatttgtggtattatgctttattgtatttctctgtgcctcaccttcgagtgagctagtgatat

SEQ ID NO: 7311 - DNA, 160 bp, Zea mays
cacattcataaagtagcgcgtgcacctcttgttgtagcttcttagctcggctacgtgtaattggtccatcaaagacttgggtcggtgatgatgttggttgtacttgagttgatgtagtatgacttgggggttgtaacgtgttgcttgatggcgtggtcat

SEQ ID NO: 7312 - DNA, 156 bp, Zea mays
aggatgtcaacttgaccatgggagccagcgagttattcaatctttacgacgacgctgccaagagttgcctcccacgagtgaggccaagttttcctgtggtgagcttggttgatccagatgtcatttgcttcctcctcgaggacaagttccgcgatc

SEQ ID NO: 7313 - DNA, 238 bp, Zea mays
aaataggtgtcgttcccggttgcaactcgatggcgaattcaatatcctggtctggtggctttcctaatagttcatcaggaaaaacatctgcatactcacagaccactggtgtgacaaccctcccaagttatcaggcccacatgcaccaatccttgccttactggcctcggatggccgtgcacgtgtaccgggtaacttaacaaggctatcgagttcgcccagtggaagtcatcatccc

SEQ ID NO: 7314 - DNA, 99 bp, Zea mays
ttttaaattgtctttgcctagtgttggaaaaaaagcactcgaccaagagctctttgtcgagtgttttatttttgacactcggcaaagaaactctttgcc

SEQ ID NO: 7315 - DNA, 73 bp, Zea mays
gtcgcggctccccgacctcgacgtgcggtggcggcggttcctcgatccggagtagaggcggtggtagcggctc

SEQ ID NO: 7316 - DNA, 133 bp, Zea mays
gcgacctgcacacacctgatggcgttcgcagcctctcccttgctgccaaggatcatcacccacatatagcgggagagatcgtcgatgagcaacaagaagtagcgtcgtcctcctggtgtggctggtgtcaccg

SEQ ID NO: 7317 - DNA, 106 bp, Zea mays
aatgtgggaaagggttgtgggccgttggatgctaaatcagaagtcatctgaggcatcgtttcttgtcctccccctaaaccctagccaccctccccccttcccacct

SEQ ID NO: 7318 - DNA, 104 bp, Zea mays
cgagtgtctaggtatgacactcggcaaagagggctttgccgagtgtctattacgtagcactcggcaaagaagcctctttgccgagtgccagccgttggctctcg

SEQ ID NO: 7319 - DNA, 82 bp, Zea mays
tatttacgcatcgttatgcagtcgttaaccgccgccatatcacagatacgaacgtggacgagcggctgtaaatgagaatttg

SEQ ID NO: 7320 - DNA, 111 bp, Zea mays
ggttcacgggctaactgtgtcacactttgcctaaggttagtcgtccgaattgaagaactaaccttagttagaaaagttagggcaaagtgtgacaagttatgcagtaaacca

SEQ ID NO: 7321 - DNA, 153 bp, Zea mays
cctgagaatccatggtcgtcaccgtcgtcctaggctcctagcagtcggcgtagtgtatggctggttattttagggttttatttttttgctagtctgctagttgctttgttgggctaggacctggggtttggtgcgctgccatgctgggcttgg

SEQ ID NO: 7322 - DNA, 85 bp, Zea mays
cggcctggtagctcggcgtcacagatctaggcgccgagctacgaaagctcggcgccacagatcttggcgccgagctgcgtctgcc

SEQ ID NO: 7323 - DNA, 169 bp, Zea mays
aacttctggcaggcttcgcaggaccttgtgacccggtttgcggcgcaaatcattgcgggccagtaaaaaccctggcggatcaccttagcagcgagggcccttggccctgcatgtgagccgcacgtgccgatgtggacttcacgtaggatctgcatgccttcggtttcgg

SEQ ID NO: 7324 - DNA, 107 bp, Zea mays
cgacgggtgacgactggtggcggcgcacgagcgcgactggcgatggagtggcaacacgcagtagtaacgggcgcgccgacgcggcttgcggcggtggcatgcaattg

SEQ ID NO: 7325 - DNA, 153 bp, Zea mays
tgttttttgacgggcactcggcaaagaagtctttgtcgagtgccgcactcgacaaagtcctgctctcggtaacggccgcgtttaccgagagcaggactctcggcacagaaatacactcgacaaagaaatctttgccgagtgccaaacactcgg

SEQ ID NO: 7326 - DNA, 96 bp, Zea mays
caagaagggggagtcctcgacgcagggccgcaaacgcggcaagccgcgcaaggcgcgcggaagagcccaggtcagggcgcgaggacaagctgaggg

SEQ ID NO: 7327 - DNA, 105 bp, Zea mays
ttcgaggagtgtttgacttgcgcatggaccccagcttctataatacaattgatttgtgtgagtgttgggtgtaggccgaacgcgacccagatcacgaagcgaagg

SEQ ID NO: 7328 - DNA, 252 bp, Zea mays
atacaaggatgctgagccccgacatgtgggcccaggatcataatggaagaaatacattatgtgaataagtaatgctgacagagtaacgcatgagtaatcagcgggagtcataatgactgcagtccatgcagtattaataggtcgttacccttttcttggtaacgcgagagtaatggtgagtcattgccctcgctatggtaacatgtgagtaactgcacggcccacgtatcgtggactgagcatgccgcctgt

SEQ ID NO: 7329 - DNA, 89 bp, Zea mays
acttcgccatgtttgacggtagccgccccgtcgtgctcgtctccggtgctcgcttcggccgcggacgctgtcgagcccgtcgttttccc

SEQ ID NO: 7330 - DNA, 101 bp, Zea mays
gtagtgccatgtggattgggtgggattgagtaggttaaaatcccaaacaagttaaaatccttcataattttttcaatcccatctaatcctcatgggatagg

SEQ ID NO: 7331 - DNA, 102 bp, Zea mays
taggttagcggacactcggcaaagaagtaatctctttgtcgagtgtattaggtgaccactctcttaaaaaggtaatttctttgccgagtgtcatctagaaca

SEQ ID NO: 7332 - DNA, 186 bp, Zea mays
ttctcatgtccctactgctgttgggagggtttggagtccggatcggggatctgcgacaaccacgttgtttaacacgtcatcagcactgctctacctcgactcgtggatccgatcggcatcgactctccatcacgccggcaggtcctccggcttttctgaactgtcctacgcgataggcttcgttcc

SEQ ID NO: 7333 - DNA, 86 bp, Zea mays
cgctggagctctactgccgccgataagccccaccgcctttttactatgctgcgggtactgtttaagccggtcagggagcgcgagtt

SEQ ID NO: 7334 - DNA, 92 bp, Zea mays
ccctcgggatgactgtgtggtcgcgccatgcttttgtttgagcttggtatttgtttagagcctgtagggcgaagacgcggtctctgtcgatg

SEQ ID NO: 7335 - DNA, 80 bp, Zea mays
agcagtcgagccagccagagcgcctgagtcaaagcagtggacgccgctatgtactcggcctcgcagctggacatggccac

SEQ ID NO: 7336 - DNA, 113 bp, Zea mays
ctcggatgaagtggtatctcagccggatgtgcttgctccgttcatgaaacacggggttattggccaatgccagagcggactggctgtccaccctgagttccaccgctccagtg

SEQ ID NO: 7337 - DNA, 118 bp, Zea mays
catgaggcgcgatgttcgagcgagcgatgtcacggaaggggcgagatgcgcgcagcgatgatcgcgcgtgacatcctctgatccggcgcatttttcttttcgtttattgtgttttatg

SEQ ID NO: 7338 - DNA, 141 bp, Zea mays
tttagaggacggtatagagtgccttgctggggccgtaggggacctgacagtcctatatatttagaggaaaggaccctttacacggtgctgttggagacagcctaagcaagccaacggtgcaagctgctgccgactggtgtt

SEQ ID NO: 7339 - DNA, 149 bp, Zea mays
aagtctaagtcaggccttgttcgtttgtgtcggattgcacccggaatcgttccagctaatcaaagtgtatataaattagagaagcaatccggctagcaatcgttccaacccaccaatctgacacaaacaaacaagacctcaggcggcag

SEQ ID NO: 7340 - DNA, 211 bp, Zea mays
ttttctccgattatgtgtgtaatgtctgcgtgatgggtgaagcgctctttttttatatgatgaagatacggttaaccgaacttgttgagtgattacgcgcacctgcatgactgtctgaggtccttaggacaaggacatctagaggtgggcctaataccttgggaggttcacagcacccttaggcgacttttgctcggatgatgtctttgtt

SEQ ID NO: 7341 - DNA, 103 bp, Zea mays
caatgccctaggcccactactcctgctccttctgctgctagaacagcatccccaactcgacccgtccaacctgtggcagggtggtaggccaagtcacaccatc

SEQ ID NO: 7342 - DNA, 78 bp, Zea mays
gaagtcttgctccaatcccggaggcggtaggcgtggttctatctgaagccatctgccatgggaagagagttgctatta

SEQ ID NO: 7343 - DNA, 101 bp, Zea mays
acactggggtgtcacagccttctcttcttaaaggaatatcgtcccaagattcgggtcaaagtcctcccacggtgaagcgaagggtgagacttatatttatg

SEQ ID NO: 7344 - DNA, 88 bp, Zea mays
ggcacgtacgtcggcgccgtagatcttgccaccgaggtatgcgccatggatctcggcgccaagatctacggcgccgaggtacgcacct

SEQ ID NO: 7345 - DNA, 152 bp, Zea mays
caagaagaaacttggcgactgccagttcgacctctaggaacagtcctacgtggccgcatgtgccgctatctacgacaagctccggcgcagacgccgcttggacgcggtgcagagcggctgctccgcgctgtccatcgtcaagcagggggacc

SEQ ID NO: 7346 - DNA, 136 bp, Zea mays
aggcacggcccaaattggcacggcacgaccaggcccatgggccgtccgggccaggcctgcacagtcctacgtgcctggccagagacccaggcacggcccttcgggtcgtttttcgggccgtgccagcccgaaaagc

SEQ ID NO: 7347 - DNA, 133 bp, Zea mays
cggggacggctgacggaactgttcgcggggacccatgttttatttcttgtggggtcatggcctccgatccgtatagaaggcggaaaggagtgaaccctgtcgccctgcactcagtcgtgtttagtgcccagac

SEQ ID NO: 7348 - DNA, 204 bp, Zea mays
cggttagcctctacacaggcggttcgaggaaccgcttgtggtgcaccgcctgtgatgtaaaacaacatcacaggcggtcaatcaaaaaccgcctgtgatagacacacatcacaggcggtccagtttaaaagaaccgcctgtgatagtcacacatcacaggcggtccggtttaaaagaaccgcctgtgatagacacacatcacag

SEQ ID NO: 7349 - DNA, 188 bp, Zea mays
tgtagtatttgagaccaagtccccaacacgtctatccagcatacccttgagagtcttttctttagtcgggtaagtcttgctgagtaactccatactcaaggttttattccctgttgtttttcaggttatagttttgtgctgttgatgatggtgttaagtgccggtgggctcggccttcttataagtct

SEQ ID NO: 7350 - DNA, 87 bp, Zea mays
gtacctcggcgccatagatcttggcgccgaggtacgcgcccgatcaacgacactacctcggcgccaagatctacggtgccgaggtac

SEQ ID NO: 7351 - DNA, 80 bp, Zea mays
acagcgtgatggcgtcgtcgtcggatgtggtgcctagaacaactcgagaggcgccgacgttggcgacgacaacgaggtcc

SEQ ID NO: 7352 - DNA, 115 bp, Zea mays
aaaaaaaccggaaccgaggaaccgaaccgaaataaccgagaactgaaaccgaactaaccgaaccgaaagaaccgatataaaattcggttctggttttttgagaaccgaaataaat

SEQ ID NO: 7353 - DNA, 244 bp, Zea mays
ccgtgcgtagggccgggcctccggtaagtcccgaacctccacgggcgtgcccggacccctaggacgggtcccggacccctccgggtggggtccgggccactcaaagcaaggtcccgagattatgggacaaagaatacctaggccttaatcaaggccaggcgggggtccggagccgacacgtgtccggaccatgccgtgtacgcttctgctccccgctcaggcggagacccgatcctgccacatg

SEQ ID NO: 7354 - DNA, 227 bp, Zea mays
ggagagggcacggacgttgcgggcgttagttatttccctccattttgtccctaggctcgcatgttggggctcagtacccttgtacgtgccccccttgagctataaaagaggaggcatgcaacgttacaacacagacccaagtcatccaagacacaactcaagctcacgagcaatacaacacacagtgaagtagggtattacgctccggcggcccgaaccactctaaa

SEQ ID NO: 7355 - DNA, 88 bp, Zea mays
acgggcgccccaccttagggcttgttcggttcctccaatcctcttctggattggtggaaccgaacaagccctaaggtggggcgcccgt

SEQ ID NO: 7356 - DNA, 104 bp, Zea mays
ggagccaagtagaacggagccgttccattcctgattctaggaatagagccgctctgttctgtgtttggtaaactggaatggagcggctctgttttttgtttggt

SEQ ID NO: 7357 - DNA, 144 bp, Zea mays
tgaatatgtttgtaaagctgaacgtgaagtgcagggacgatgatcaaagacttatactaactcttttgcaggccggggtccgacacacagctcaactccttccagccctgcaccttctacgcctagcactacaccgcgcacagg

SEQ ID NO: 7358 - DNA, 83 bp, Zea mays
ttagctcgtcgccgtttgcccgtgcgcagcgagtccgttcacggaccaatccctctgccaccgtagaccggctagcagagcca

SEQ ID NO: 7359 - DNA, 201 bp, Zea mays
cattactagctgagtgcccgtgcgttgcaacgagaatatataataccagtatattacgataacttatatacaaaatgtgtgttatattgttatgagaaaatgtttcataatcaatttatgatcctagccatacataaattttgttattttaatatagttgtttcaccactacattgcaaccatcagtatcatgcagacttc

SEQ ID NO: 7360 - DNA, 251 bp, Zea mays
tggttgcatgtatttgctagtgcttgtgttgcgggatgtaataagttggtgtttggttgttgtcaaccaggctctacgcgtgcgagatgtgtgtttagttacctgcatgcagatgtggagtcaggctcgcacgatacttaaaacaccctgagccaggctctgcaggcgcgagcaaattggtcgcatctctggagttaggctcccgccgatttagctcatgcagccaggctacggggagaagccaaccaaac

SEQ ID NO: 7361 - DNA, 110 bp, Zea mays
ccacaaagggtgttggtcgattaagacagcaaaacggtggtcatggaagtcgaaatccgctaaggagtgtgtaacaactcacctgccgaatcaactagccccgaaaatgg

SEQ ID NO: 7362 - DNA, 120 bp, Zea mays
gctagtctctttgccgagtgccaggactataacacccgacaaagaagctttaccggttcccaggtgtgccttctttgccgagtgctatgatcattgcactcggcaaagtgaccaaaaccc

SEQ ID NO: 7363 - DNA, 91 bp, Zea mays
gacgaacgggcccttcggtgcgccgccggcctgagcagcgggcgcaatttggttgaggagtttgtggcgcacggggtgtggcctttggcgc

SEQ ID NO: 7364 - DNA, 91 bp, Zea mays
cccatggcctgtgacgtaagccaacgggcggagcctgacgtatggcctctgcaccgcaggccgcaccgcgggctatgtcgcaagctacgct

SEQ ID NO: 7365 - DNA, 84 bp, Zea mays
aggctttttacatcacaggcggttcggatagaaaaccgcctgggatgtcctaggctttcggaccgcctgtgctgtattagtatc

SEQ ID NO: 7366 - DNA, 109 bp, Zea mays
tgatagtcacacatcacaggcggtccggtttaaaagaaccgcctgtgatagtcacacatcacaggcggtccggtttaaaagaaccgcctgtgatagtcacacatcacag

SEQ ID NO: 7367 - DNA, 183 bp, Zea mays
caatgctgccgggctcgccggtgaagcgcctgctgcggctggcggccaaggggcggcgggagaagaccgagctggcggggctggccgcggcgaaaaaaaagctgctgctgctctgcgccccctcgctccgctgctcggccgccgcgcgcgggaggctctgggccggtggggtctccgtcacgg

SEQ ID NO: 7368 - DNA, 248 bp, Zea mays
atgcggccacgaggacggcggcgtgatttgcgtgcggagctggcgcggcggcagccgatcgcccgatcgcgggaggcagaacagtagctgtgcacgcctacgctaacctcatatagagtagtagtatatatatatatatatatatatatatatatatatatataccaattgcgttccccgattaggcgcgatgagtcggccttatcagttccctagcacagattatgtccaccgactcgactaaagca

SEQ ID NO: 7369 - DNA, 96 bp, Zea mays
ccgacggcttaaagccgtcggagataaggctttgccgtcggaaataatctatttccgacggtttattccttatgtccgacggttttgaccgtcgga

SEQ ID NO: 7370 - DNA, 166 bp, Zea mays
gaagtgtgaattaatctttgtcgagtgtcccctggccgacactcagcaaaggatcctttgccgagtgtcgctgatctggcaatcggcaaagcttattttaaaaataaaaagaaatctttgtcgagtgccagatcgcgggcactcggcaaagaaggaaaaatatact

SEQ ID NO: 7371 - DNA, 111 bp, Zea mays
cacattgactgtcagcagggtggacaggcgactcgtcctttccgcaataaatgcagagaccgcgcggcctagaggccttacgtcaggctccgcccgctggcttatgtcacg

SEQ ID NO: 7372 - DNA, 156 bp, Zea mays
tagtcggttacccgtgcgttgcgacggctcacaacaatacccacgtaaattatccaccaaaaagatagataatcaataaaaaatcttgagatatttttggtggataatttacgtgggtattgttatgagtcgtcgcaacgcacgggtaaccgacta

SEQ ID NO: 7373 - DNA, 78 bp, Zea mays
gactcggcaaagagctctttgtcgagtgttatatttttgacactcttgacactcggcaaagaagctctttgcccgagt

SEQ ID NO: 7374 - DNA, 141 bp, Zea mays
gtacggtcgtactgttggactgcgggtttctcgaagcgtcgcgctctgtcggattgcgggtttcccgaagagccgcgccctgcctataaaacgggcgggggtcggcgctttttgaactttgccttccacgctccgcgaaaa

SEQ ID NO: 7375 - DNA, 129 bp, Zea mays
aaacactcggcgaagtctttgccgagtgtgacactcgacaaaaaaaatctcgatgaactgtacatcgacaacggctttttgccgaatacttttttgtcgagcactcgacaaagactttgccgagtgcca

SEQ ID NO: 7376 - DNA, 127 bp, Zea mays
acaaagagtgagcctttgccgagtgtcacggtggcagtcagcaaagtctccgtcgccgtcatcaggcgccgtgatggcgacttttctttgttgagagtcacgtggcactcggcaaagtctttgtcga

SEQ ID NO: 7377 - DNA, 155 bp, Zea mays
aattgaaattcataaagtagcgcgtgcgcctcttgttgtagcttcttagctcggctacgtgtaattggtccatcaaaaacttgggttggtgatgatgttgattgttcttgacttgatgtagtatgacttgggggttgtaacgtgttgcttaatgg

SEQ ID NO: 7378 - DNA, 114 bp, Zea mays
aaggggattgagggctgatttggtgactagaaaaataattttgaaaagcaaggggattctttcccatggatcctctgtatttttctggttaccaaaccagtcctgaaggagatt

SEQ ID NO: 7379 - DNA, 157 bp, Zea mays
gcgtgcttggcttggagcaatttaggatgggtgtccgaccgggaagttttctcgggtgcgcatgagtgaggacaaagtgcgcacaaaagactcgtgttggtctataagaacaatatatgatcctagagagctgccaggagtaagtatcgccggtcca

SEQ ID NO: 7380 - DNA, 171 bp, Zea mays
tcgacgttttggaggcgtaggcgagggattagctgatatagaaaagcagggaatagaccactcgctaaaacgaacaagaacactctattacttggtaacctctttgattaaaaccatagatactcacgtcgtctacatctgttatctctctcctagcagccgtcgttcttt

SEQ ID NO: 7381 - DNA, 82 bp, Zea mays
tccttcatggacgccaagataaaaacatagtggcgccaattatgttggcgccactatgtgttacctcggcgtcaatgatgac

SEQ ID NO: 7382 - DNA, 73 bp, Zea mays
ttaagggcccgttcgtttccgtcggattgggctgtttctggcctggttccgagcggaataaattggcctgaat

SEQ ID NO: 7383 - DNA, 64 bp, Zea mays
caaagaagctgttgccgatgtacagttcgccgagcgatctttgccgactgttacactcggcaaa

SEQ ID NO: 7384 - DNA, 80 bp, Zea mays
tgcctcgccggagaagccagtccacggtcgtcggacttcacccgaccgccggtgaacgtagaccgagctcctcggtgagt

SEQ ID NO: 7385 - DNA, 83 bp, Zea mays
cacatcatatctcggcgccatagactgtggcgccgaggtgttacctcagcgccacagcctatggcgccgagtatcgggtccaa

SEQ ID NO: 7386 - DNA, 166 bp, Zea mays
tgctgagcgccgggtttcgccgagtgtttggcactcggcaaagttatttttgccgagtgtcttcctttgccaagagtcctgctctcggtaaacgcgatcattaccaagagcaggactttaccgagtgcctgatagaaagcactcggcaaagccccgagcactcggc

SEQ ID NO: 7387 - DNA, 152 bp, Zea mays
ccgagcccctgccgccgtagaccggctaacccagcctttcccaaccccgtccaaccctcggagacgagtgagcacacctcggtgaagctccccgagcgaggaatcgaagtctgctttgccggagaagccagtccacggtcgccgaagttcgc

SEQ ID NO: 7388 - DNA, 196 bp, Zea mays
catagacaaccaagcttgcttcgcctcagtctatcatccgcagtccaacggggttgtggaacgcgccaatgggaaaatcttcacagatatcaaaaagatgctcctcgatgagaaaaagggcagatggaccgatttgttacccgaggcagtctaggcactaaacacgactgagtgcagggcgactaggtttactcct

SEQ ID NO: 7389 - DNA, 194 bp, Zea mays
aagtctgcacgggtacctgttggttacaatagtagcgatgaaacagttagattgaaaaaacaaaatttaagtatggctaggatcacaaattgagtacgaagcatttacacaaaccagtataacacacatttgttcataagttatcatgtgttttttgtttctgttgcaacgcacgggcacccatctatatgtat

SEQ ID NO: 7390 - DNA, 213 bp, Zea mays
aaatgaactagtgccgtttggttcacatactggtaacgtaatgggtaaccgataacgttaaatcatgtttgtttaagttcaaccgtaatcgataccacattacaaatagatagcgccttattcaaattttttaccgctactattagagtgtgaatcgttaccattaccatttacgttacatttcgcgaaccaaacggcacctaatttcctgtc

SEQ ID NO: 7391 - DNA, 142 bp, Zea mays
ctcggcaaagcggtctttggcgagtgttcttctgtgccgagcgttctgctctcggtaaacatggtcgtcatcaagagtaggactttactgagtgcccactcggcaaaacatcgagcactcggcaaagaaccgaattttagta

SEQ ID NO: 7392 - DNA, 107 bp, Zea mays
ggtatatgcccgtgcgttgctacggaatcaatataataaaatacaataattttggtatatcaatgtatgttatcaaattaattttgtaacaacgcacaaacatatac

SEQ ID NO: 7393 - DNA, 89 bp, Zea mays
gttattcctttcagctcgatgcttgcatgtgccaccagcacgcacggtacgccctccgcctgtgcgacgttggcctgaccacgtcgtgt

SEQ ID NO: 7394 - DNA, 184 bp, Zea mays
gctagtccggcgggcactcggcaaagatggagcctttgccgagtgcaatctaatacgctcggcaaaggccatggtaaaggggcccacgggggctcctttgtcgagtgtccgtacattggacactcggcacagactctgtcgccgtgacgtcgacttttctttgccgagtaccggctgacactcg

SEQ ID NO: 7395 - DNA, 231 bp, Zea mays
gcggtagtggtcccgcttttgccgctttgtgtcgaagtcggtgctggaccccccagtgatcatatgaatgactccacgatacggctgatcggcgaagtcttcttgttttggggcgtgggggtgggggatgttctgatgttgctggtgtggaggtgggggtggaggaggtacgatttgtacttcctggtgttgttggtatgcgtggtgcggtggatgcggggcgggggcgtg

SEQ ID NO: 7396 - DNA, 81 bp, Zea mays
ggataggtcccacccgcaggtaaataatacaactaaaacgttatctggtagacctgcaggtggggcctatccacctttttg

SEQ ID NO: 7397 - DNA, 199 bp, Zea mays
gattaagtaagggggtgtttggtttctggggactaatttttagtctctcaattttattccattttagtccctaaattactaaatatagaaactaaaactctattttagtttccctatttaacaatttatgaactaaaatagaataaaatagagggactaatgtttagtctctataaaccaaacaccccctaaaattgga

SEQ ID NO: 7398 - DNA, 86 bp, Zea mays
ggaccctttgctcgacgtcatagcctatgacgccgagggaacacatctcggcgcccataggctatggcgctgaggtacgtgctgcg

SEQ ID NO: 7399 - DNA, 196 bp, Zea mays
gcagcagtgcgtcgacagtctatggatttgggtgttttatcgaataggcgggatgtgaggagccgagcaatcacttgaacatggtcgacgacaaggtctgccgggagagaatatcggcacacgacgcggcacgacgaacgcgcagagcttcaaaaccacgcgcgcgagatccaactactgcgcgatgcactttagg

SEQ ID NO: 7400 - DNA, 84 bp, Zea mays
gtagactttttacatcacatgtggttcggttagaaaacatgtctcatgctattcgaaccgcctgtgatgtattagtatcacaag

SEQ ID NO: 7401 - DNA, 106 bp, Zea mays
atggaccgagctggtggcccagacacgacactatgtacgggccaagcccgacttctgttgtatatggaccaggttgtgtcgtgcctgggccatgcgtttgagtgcc

SEQ ID NO: 7402 - DNA, 132 bp, Zea mays
agagttcaactaggcgggccgatgagcatcaccacacgtaatggaacccaaaacacctacaagctcgaccgtggttacctcagagagctctggccacaacgagatgtctcacggcggcgctggcgaccgatt

SEQ ID NO: 7403 - DNA, 112 bp, Zea mays
gtgaatgactccgcgatacggctgatcagcaaagtcttcctgttttggtgcttgggggtgatttgagtggtggatgtttggctgatgcgggtgtggaggcggaagtgggggt

SEQ ID NO: 7404 - DNA, 130 bp, Zea mays
ctctcacctacgggtcttcggctgcctcgtgttcaccaaggagcttgtcttcattggcaagctcgacgacaggagcaccccaggggtgttcattggctacgcggagggctcgaaggcgcgtgtcttattt

SEQ ID NO: 7405 - DNA, 89 bp, Zea mays
tttctctctcctctccgcacaagactgcatacgctcgcgggtgctcgcgggacccagctgtcacagtctgcatgcggagtgtaaatacg

SEQ ID NO: 7406 - DNA, 73 bp, Zea mays
atcctacgtcgtgaagatcgggcatcgtgatgcatcatttggtatcggagcctcagttgccacggtaggattc

SEQ ID NO: 7407 - DNA, 128 bp, Zea mays
actcggcacagaagcctttgccgagtgcccgttatccgggatgccctctagtttattttaaaattttaaaaaaatctttgccgacgttcaaaaagggcgggcactcggcaaagaattttaattaaccg

SEQ ID NO: 7408 - DNA, 130 bp, Zea mays
atgctgggcgccatagcctgtggcgccgaggtatgacgtggcagcaacggctacctgcgcccagggctgacctgtcatcgatgtggaggcgacgtggcctcgtagctcggcgccatagatcttggcgccg

SEQ ID NO: 7409 - DNA, 237 bp, Zea mays
ggggcacgcggggtcgggcgtcgggcgtgctctagcgaggtcagggcgcgtcgaacacgtggaggtgtttttctgcccttgttcaaaagcttgctgagatcgcaaacgtgcgaatcttggcaaaaatcctgcgcggaccttttccttgcacctagggctatctcttgtatgtgagttccaacgggagatatgccctagctagggagatatgcggacgccaaatctaggttgtctcac

SEQ ID NO: 7410 - DNA, 165 bp, Zea mays
taagaacgtgggtaccgtcgaacttaacattaagaacgtgagtaccgtcgaacttaacattaagaacgtgggtttttaagttcgacggggaccgtcgaatttttccccataagttcgacgacacccacgttcttacatttaagttcgccggggccacgtggccgt

SEQ ID NO: 7411 - DNA, 194 bp, Zea mays
agtaagaacagggccttggcaaggttccgggacctgttgtgttcttggcacgaataggggttcggggccaacacgtgtccagcccttgccccttgcttcccgctcaggcggagtaatatatacagccgcaaggctagtggcccgtgacataagccaacgggccgagcctgacgtaaggcccatacagccgtgca

SEQ ID NO: 7412 - DNA, 232 bp, Zea mays
ccccccggggtcgaaacgccgacagatcagagtatttattacatagcaggctttctggattgggcctcaaattcctgaaagcgcagggggctatcctataaatattcctagactcagccaacaacctatctagacggtgggttgttttctaaaacacccagggtattttatgcaagtagctcagcacgaaggggtatcatgtgatatcggtcgttggatccctgaccgagcg

SEQ ID NO: 7413 - DNA, 116 bp, Zea mays
catcgggcctcctcgttcttggccctatccacatgctgcaaggtgaatcccttgaactgtctctcgagactttcggatggctgtgaggtattgcatgagcgcggggtctttttgct

SEQ ID NO: 7414 - DNA, 103 bp, Zea mays
ccagggcatggcgtcaacggatttctgcagctcgcggcacacccgccatacacacagagaggagcgcggcggcctgcggcttctgtttgcgaccgagcggggg

SEQ ID NO: 7415 - DNA, 108 bp, Zea mays
taggtgttaatgtcgtatagtgccggcacgacacgattaggcactataatgtagtgtctgggcgctggttaagcattagtgccggcacgacacgacaaaattattaat

SEQ ID NO: 7416 - DNA, 85 bp, Zea mays
aatcattccggagcttcaatccgtgaaaatcgaacagggcctaagggtatatttggttccagtggattgagcgcccagaataatt

SEQ ID NO: 7417 - DNA, 110 bp, Zea mays
tggttcgtagctaactgcgtcacattttgcctaaggttagtcgctcgaattaaagaactaaccttatgcagaaaagtttggcaaagtgtgacaagttagacagcgaacca

SEQ ID NO: 7418 - DNA, 136 bp, Zea mays
ttgtactaggtgagtgctcgtgcgttgcaacggaaatatatatcacgataacttataacagtataacccatttttgtacataagttattatgatatatgttctcgttgcaacgcacgggcactcaattattaacaa

SEQ ID NO: 7419 - DNA, 84 bp, Zea mays
ccgagtgcccgcgatctggcactcgacaaagaatatttttatattaaaaaaatctttgccgagtgccagatcacgggcactcgg

SEQ ID NO: 7420 - DNA, 106 bp, Zea mays
ctgccagttcgacctctggaagcagtcctacatggccgcatgcgctgctgtgtacggtaagctccggcgcagccgccgcttggacgcagtccagagcgggtgcacc

SEQ ID NO: 7421 - DNA, 79 bp, Zea mays
tcgtgtggcacacctgccggaaaagtacgatggagctaaacaacgcgatctgtgaattcttgtcaggtgtacgtcactg

SEQ ID NO: 7422 - DNA, 94 bp, Zea mays
cctctgcggcctggcattgtgacgtgtggcgagcgttaaccggtgtctggacagcgcacaacctctcgcccacgtgaacgatgcgtgtggtcgt

SEQ ID NO: 7423 - DNA, 77 bp, Zea mays
gagcagctctttgctccggcacgaggacatactctccgtcggcgaggttacagtctatctgtcggggaccataatta

SEQ ID NO: 7424 - DNA, 75 bp, Zea mays
gcatctcgctgcgagccaggctgtggagaaacaggttttatttctgtatctcgtgagctaggctctggctagcct

SEQ ID NO: 7425 - DNA, 79 bp, Zea mays
gtgaccgatcgaacgtgacagcacatgcgactgtgcacgctcctacgcacgtcagtgtgccagtctacgctgcaaccct

SEQ ID NO: 7426 - DNA, 82 bp, Zea mays
tcgatcttgacgtggcgctggctgcagcgatgccgcagttgccgcagtgttgctgggtccagcgccaggatcaccaccggtc

SEQ ID NO: 7427 - DNA, 100 bp, Zea mays
ccgtcttacggcttctgaggccttctgtggcagaaccacccgagtgagagacccacatgcacctgtcctgtctcaaagacctcagacagctatgcatggc

SEQ ID NO: 7428 - DNA, 104 bp, Zea mays
agctcggctcggctcggatcggctcgtttgaatttttcacgagaagagctgacatcctagctcggttcgttaacgagccagctcgcgagctaaatgagctacca

SEQ ID NO: 7429 - DNA, 170 bp, Zea mays
actattaggtgagtgtccgtgcgttacagtgctgagtttctctttgataccattctggatggcttatggatattgtcatccatctcataatcgtataacacatatttgtatatataagttatcgagatattatatgttccagatgcaatgcacggacactgacctatctt

SEQ ID NO: 7430 - DNA, 111 bp, Zea mays
gggtgaagggtggcgctttcagcgctggcggcgagattgcggcggccactgctatcaaggacgaagtgggcaccatgtcccgccggctgagggaggcgtcgcagcagctgt

SEQ ID NO: 7431 - DNA, 115 bp, Zea mays
aagggtccagtgccggcacgtgtccaggccttactctacgctttctgctgagacgaaggcccgctgctgccgcgtggagtgtggcccgtgacataagccagcaggccgagcctca

SEQ ID NO: 7432 - DNA, 173 bp, Zea mays
tccggtgatctctggctcgggcgaggctcggggtgtgcaagtgccaacgtctaaggcctctggaggcatttataggtgagggcaccacacaggcgcgcagggcggggcaaccacgcgcggggcgcgcgctgccgcggccagtccgcgctcggccggtcaggcaagcgatcgaa

SEQ ID NO: 7433 - DNA, 81 bp, Zea mays
gccttcgacagcaccctcagcaacgtaaaaccaaaattcattccaattgccccacttgttgcgggcgcacggaaccaactc

SEQ ID NO: 7434 - DNA, 205 bp, Zea mays
gcatccgcgccgaagactcccggagctcgggcgaagacatccttcccccgggggctgcgcatgtccccatcaattccatagcaaaactatcggagaccccccagttctcccatcgcagtacctagcctcctcttcttagtggatggggcagcctccggtgcggggtcgtcttcagtctcagccgccgggtttttcccgcggcggt

SEQ ID NO: 7435 - DNA, 129 bp, Zea mays
ctctctctttagggctgatttggtgacaagtggatcacgggtggataggaggggattgagaaagaaatgacttaatccccttcaatctatttataatacttggtcactaaatcagccctgagtaattac

SEQ ID NO: 7436 - DNA, 106 bp, Zea mays
ttgcttgggacgccataggctatggcgccgaagtacgtgctgcgctggcacaattcggacgacgtggcaccaaactcggcgccaagatctatgacgccaagctcgg

SEQ ID NO: 7437 - DNA, 123 bp, Zea mays
taggtaaacttttgatttgccagtgttttgctttgcctagtggcggacactcggcaaatgactgatttacctagtgtcttactttgcccagcgtaacactcggcaaagaagatctttgcctag

SEQ ID NO: 7438 - DNA, 131 bp, Zea mays
catgaggagggtgaagccgtggtaacaccaagtatgcacattagattcttaatatattaagtatatattgaggctgtcacacctttgtgacgagtgcaaaacgtgttgaatggtcttagatcgtctatagc

SEQ ID NO: 7439 - DNA, 111 bp, Zea mays
gcactcggcaaagtctttgtcgagtgtctgataaagaagtcgttgtcgatgtacagttctccgagacttctttgtcgagtgtcacactcggcaaagacttcgccgagtgtt

SEQ ID NO: 7440 - DNA, 191 bp, Zea mays
aagtctgcacggtactgttggttgcaatgtagtgatgaaatagttagattgaaataacaaaatttatgcatggctaggatcacaaattaattacgaaacattttcacataacagtataacacacatttgttcataagttatcatgatattaaatgtttctgttgcaacgcacggacacccacctatatgtg

SEQ ID NO: 7441 - DNA, 73 bp, Zea mays
ttgtttatgtagagcccaaaaaacccctcatttgtagctacaaatgaagaagttttaagggctataaaaagtt

SEQ ID NO: 7442 - DNA, 108 bp, Zea mays
cggcaaagttctctttgccgagtgtctccctggtgacactcggcaaagattatttcaatgtactttgccgagtgccaccattggacactcggcaaaggattatgtgcc

SEQ ID NO: 7443 - DNA, 215 bp, Zea mays
tcgacaaagacttctttgccgagtgcccccagggtggcactcgggcaaagatgtgtaaggtaatatttgccgagtgtcagatggtagacactcggcaaaggatcctttaccgagtgccaccgatctggcactcgggcaaagtttattttaacaatttaaaaaaactctgccgagtgccagatcacgggcactcggcaaagaaggcgaatatactc

SEQ ID NO: 7444 - DNA, 115 bp, Zea mays
ggcaaagctatcttttgccgagtgctcagcctgcgtgacactcggcaaagactatttccctattctttgccgagtgccacgcagctggcactcggcaaaggaatctttgccgagt

SEQ ID NO: 7445 - DNA, 72 bp, Zea mays
gtgctcagcctgcgtgacactcggcaaagactatttccctattctttgccgagtgccacgcagctggcactc

SEQ ID NO: 7446 - DNA, 126 bp, Zea mays
cggcaaagaggtgctttgccgagtgtcaggaccatagcactctgtaaagaaccaagacctgggcaccggtataggttctttgccgagtacggcggtcttggcactcgactaagaacctgacttggg

SEQ ID NO: 7447 - DNA, 76 bp, Zea mays
tatgaccttggcactcggcaaagaaggaaacctgggaaccggtaaagccatctttgccgagtgctgaccatggcac

SEQ ID NO: 7448 - DNA, 151 bp, Zea mays
cgggctcgaggctaggccttcgcccgggatgccctcgggcgatgctgatttttacttcccgtcaaagggggctccctgggtgtgtccaggatccatgcaggcgcagccttcgcctgaggatgggctcgggcgaggcgtagttttgtgcaac

SEQ ID NO: 7449 - DNA, 80 bp, Zea mays
agcagtcgagccagccagagcgcctgagtcgaagcagtggacgccgctatgtactcggcctcgcagctggacatggccac

SEQ ID NO: 7450 - DNA, 158 bp, Zea mays
cgtgaccgccagagtctccccgagccaaccccacccttcaccggacctccctcgctgccgggaaagccgcgacacccttttctttcccgcggttaactgttttagtttgggggaaggactgcgggtgagaggggagagaaggccggggggttttgtga

SEQ ID NO: 7451 - DNA, 156 bp, Zea mays
agctgaagtgtaagggcttgtttggtttgtggctaaatgtgtcacactttgtctaaggttagtcattcaaattgaataactaaccttaggcagaaaagttagacaaagagtgacaactgaggtagtgaaccaaacaggcccttaagtgtgtaaccc

SEQ ID NO: 7452 - DNA, 246 bp, Zea mays
tactttagggggtgtctggttgatcctgctaaagtttagcccgggtcacatcaagcgtttgacttttaaataggagtatgaaatatagacccaaccaactggactagattcgtctcgtcttttaatcttcggctgacaaattagttttataatccgactacatttaataccccgaacggaggttcaaacattcgatgtgataggggctaaattttagcaggggcaaaccaaacaccccttagtgac

SEQ ID NO: 7453 - DNA, 137 bp, Zea mays
cagctggctctgttcggttgtacaggattggagccagaattattccacctgatgaaatcttatataaaataggtaaataatccatgcaggaatagttccagacaaccgttcctgagcaaccgaacaacccctaaggc

SEQ ID NO: 7454 - DNA, 183 bp, Zea mays
ttccgctccccgctcaggcggagacccaatgctgccgcgtggccgactgcccatgacgtgagccaacgggaggagcctgacgtaaggcttatagagtcatgcgtcctctgcatttattgaggataagacacgcagcatgtccattccactggcaggtggtgtgccgccttagcatttaatatg

SEQ ID NO: 7455 - DNA, 151 bp, Zea mays
tttggcactaggggcatgtttggttcgctgcctaatttgccacactttgtctaacttttgtgcctaaggttagttcctcaattcgaacgactaaccttagacaaagtgtggcatagttagccacaaaccaaacaggccttagatctcgtgc

SEQ ID NO: 7456 - DNA, 149 bp, Zea mays
ttggcgagcgtcgcgggtatgggtttgtctctggtatgatgctgcagcaagaagggaaagaggagacatccggtctagtggcgtggatgttggagcagggagaactccacgctgagatgcacagacgacatgctagcgacgcagggagt

SEQ ID NO: 7457 - DNA, 139 bp, Zea mays
ggctgcgcgcggagtcggcggatgttgcgaggtcggtggctgcgagaacggggatggcggccgcggggtcagcggatcggtggatcagcggatgctgcgggatcggtgggtcttgtgaggtcggcggatgcgggaacgt

SEQ ID NO: 7458 - DNA, 102 bp, Zea mays
aatattttgatcgtgatccattaccacacatagtcctagctgaacaagtctaggtgagacttgtctagggaacttgagggtggtgcaattaccttgtgggtg

SEQ ID NO: 7459 - DNA, 92 bp, Zea mays
ttggtttgaagaatcgctccatccacgaacggtctcggcactttgcgacatgggtgatgatgtgatttgtgacatggggggattatgttacc

SEQ ID NO: 7460 - DNA, 216 bp, Zea mays
ctgccgccaccaccaccaggaggagggaacgcgaagagcgagtcaacaaatctagtccctactgctggatcagacccactgccacccgcttcaggcgtaacctatgcaagttagcaaatatcaacacgttaaatgcaaatatcaaaaagtatacaagtgtataaattaatggagagttatcgaacgtaccctatctccaggtgcaggtatatgtgt

SEQ ID NO: 7461 - DNA, 96 bp, Zea mays
ccttccatcagacactcggcaaagaagccccctttgccgagtgcctcctagagctctcggcaaagaaggcttctttgtcgagtgtctagaaggaca

SEQ ID NO: 7462 - DNA, 87 bp, Zea mays
ccgagtgtccgcgatctggcactcggcaaagattttttaaaaatattaatattattctttgccgagtgccagatcgcggcactcggc

SEQ ID NO: 7463 - DNA, 235 bp, Zea mays
ggactttgggtcagtgtctctagcgttgtcccgtcataaaaaacaaactatcacgaaatgtttttatggattttatcttcattgatggagataaaattatagttatgtaaacattcttaacctttaaaaagatgctaacaagagcattaaacgataattaatgcttctacatctcattgtatcttattataacatgtttctttcgtagcaacgcacgggcatacacctagttctc

SEQ ID NO: 7464 - DNA, 106 bp, Zea mays
ttatcttgaccgcgtcagcacgcgactgtggtcgtgttcatcgaattcgccaacgctttgttgccgattcgactgtcgtcgcttcgcgtgttgtcgagcccgttgg

SEQ ID NO: 7465 - DNA, 142 bp, Zea mays
caaaaccttgagggctgatttggtgactggggatccccagggaaagaaaacctcttgctattcaaaattaaattggaaggggattcctcccccatggatccccttgggatccctaatcaccaaattagccctgaagggccca

SEQ ID NO: 7466 - DNA, 72 bp, Zea mays
agagacattacactcggcaaagaacctatgccggtgcccaggtcttggttctttgccgagtgttatggcctt

SEQ ID NO: 7467 - DNA, 128 bp, Zea mays
tctggtatatagtgctcgcggaaggccaccttgaattcttcccaagttatttgatgattggccggttgaacggccacaaaattaccccaccaagtgctggcaggtccgcgcagttgctgggctgcgaa

SEQ ID NO: 7468 - DNA, 251 bp, Zea mays
aaggtgggaatagagacagtgcccatgggaaagtgggaaaatggcgcggaacaaaaaaagcgccacattacttcgagaattggaatagtatagccacatttagagaacaactgaggttaaatcagaagggattaattttaagaagttaatttaggggattgttggagagatgttttcatctaaactctctaaaatactaatttgagaagtttcttagaaaactattggagttgctctaataccgttataca

SEQ ID NO: 7469 - DNA, 75 bp, Zea mays
aaaagcggtaggctttttacatcacagacgggtcggttagaaaaccgcctgagatgtcacaggctattcgagccg

SEQ ID NO: 7470 - DNA, 115 bp, Zea mays
ggtttgaagtcaaagtaggatgagtcggggcaccaccgtctctttaatttttttggatcacgccgcccccaaaaatcactctggtgttcacctcgcccccgtttgactctcaacc

SEQ ID NO: 7471 - DNA, 169 bp, Zea mays
acagctacccgctgcggggacggggaaagaaaaggaaagttgctgcttcggccgaagagttcactcgcttacgcccccccagatgagcctgcgccgaagagtgaaatgttgactccttacccactgtaacaccttgtccaatccctggaccggcggtacttatacctgg

SEQ ID NO: 7472 - DNA, 116 bp, Zea mays
cgcacttgttgtgctagtcctggctgcacccgtaggcgactttcgcacggatagtcttcgcggaagacttcgatttttcgcacttgttgtgctagtccggctgcacccttaggcga

SEQ ID NO: 7473 - DNA, 114 bp, Zea mays
ccagggctggcgctgactacagggctgccacgacggccgccttgggcccccagatcctaggggccccacccccatgcatgcatatgtagtagtcttggatcagttaaggcttga

SEQ ID NO: 7474 - DNA, 118 bp, Zea mays
ccagaacctaacccgaggtccttcttctaccaaaacagtagccgcggcgaagaaaagggcggaggggcttaccggcggcgagactgttccggtgaagtggtcgagggtgaaggggagg

SEQ ID NO: 7475 - DNA, 149 bp, Zea mays
tgaattgataggtatgtatgtcgcgatgattattccgcgtgtagctcaggcacgtatttatttgacgcttgtaggaatacggggctacctgcagcatggtaattgtgtccccgattgcgaagtcgtcgtgctgcgtagctaagtttagg

SEQ ID NO: 7476 - DNA, 179 bp, Zea mays
gactaagaactctaagttacttcttgacttagtttcgtttacaaaatgttattaaatcttgcataatcatgacatacatgttcattgcatttcgatagactgtaatcttgctgacggagagtacatcctcgtgccggagcaaggagctgctcaggaggtagccccagatccagcacccg

SEQ ID NO: 7477 - DNA, 132 bp, Zea mays
gatctgtgtcgtccgacatcagatgctccatgtagcgttcgttagaagtgcaattatgcagcaccggttcactcccagaaaaacaacggacgacctcatgcaggagcagctcatgccggatcaactgaattc

SEQ ID NO: 7478 - DNA, 73 bp, Zea mays
cacgcctatagtgtcgtgcctgggccaccatctcgactcgtagtgctggcacaggcacgacacatttacattt

SEQ ID NO: 7479 - DNA, 75 bp, Zea mays
tcatcccttgtgtgccactgagtggcatataagtatatttttttgtgtctatgacatgtggggcatacagggaat

SEQ ID NO: 7480 - DNA, 198 bp, Zea mays
cacttatcctggtgcaagcatgcaatcgagcgatctggtgcatccgatctagatctaatgatgactgttattttatatttaactccttccacctaaaacatagtacttattttacttttaacccctttcatatgaaaccgttggatctagattagatgctctgaatagtttgattgcacgcttgcaccaaaatgagtg

SEQ ID NO: 7481 - DNA, 78 bp, Zea mays
cggcgagatagatatagtgaggtggccgagggtgtaggggaggttctgacggtcacggcgatgtgcgggtcaccgtcg

SEQ ID NO: 7482 - DNA, 215 bp, Zea mays
gaccttcgacattccgaagcctttgagatttttcgcggatcgagctcgttacgaaaaacgatctagcaccgcgaaggggctactgttggggggccttcttcctcgccgaaggtcctccaagcaaaaacaccttccgcagggtaatatgcaagcagacacaacacgaaggtataagccaaagctacaatccagggagcttcggcatgacaatgcgc

SEQ ID NO: 7483 - DNA, 109 bp, Zea mays
cctgggttgttccgttgttggagatgccctcagtccggtaggttacacgcatgatgcgttgcgtgggatcccgatccgcgacggcattgcgcgacacggccaggcccag

SEQ ID NO: 7484 - DNA, 97 bp, Zea mays
aaataagctcctctttgccgagtgtcttccagagctctaggtaaaaagactggcaaagggtctattggagccacattcggtaaagagtttgtcgaat

SEQ ID NO: 7485 - DNA, 171 bp, Zea mays
ggggtaggcgtggcagcgggggcgaagggcaggaggccgtggtgggaagcggcgagcgccatgggtgggtgcgcgcaatctggagcggagcggggcggagaggcgtgcggcgtgtcactctgcccaccgtgaccgtctccgccctcggctcactggagtggcgttggcgcc

SEQ ID NO: 7486 - DNA, 226 bp, Zea mays
ggcggtgctcggccagagttatgcgctgggcgtctgggagttttccatcgcggactcgtcgtcgggaggactgggctccctcgtcgtgtgttgaagaccgaactggacgacgatggtgcgaggctgctcgttcttgtgcaaagccacggtaaaacacacctccctgcgtagttctctatcgatttctccctatagtttggagcgtcaattatggttagccgtggga

SEQ ID NO: 7487 - DNA, 88 bp, Zea mays
aggcctcaccggcgagatgctggttggcgatgttgtgtacctgctactgattgcggccgtctcgaccggagtctgcctgcgaaggtct

SEQ ID NO: 7488 - DNA, 136 bp, Zea mays
ccccgtaagtgcttgttcggttacaccaatccagaaaaggatcggaggtgtttaaatctcctcctggtcatttttgactagaaggggatttaatccccttctggattggtgtaaccgaacatgtttctatgtgttt

SEQ ID NO: 7489 - DNA, 135 bp, Zea mays
atgatcctagagagctgccaggagtaagtaccactggtctagggattggacggggtgttacaaccccctactgaattgatccaattaatctagcaggccagtcaaagcgggctcctactggctctagtggtccag

SEQ ID NO: 7490 - DNA, 236 bp, Zea mays
cgctgcaattgataaccatagcgtcgatgtggggggcgctgcgcaggtcaacgtctcgtgcgtcgaaggttagcggtatgtgggaccactttgtctgcacgactgggccagtgacggcgacatggttgatgctgcggtagtggtcccgcttctgccgcttggtgtcgaagttagtgctggaccccccagttatcatgtgaatgactccgcgatatggttgatcggcgaagtcttcc

SEQ ID NO: 7491 - DNA, 109 bp, Zea mays
agtgtttgtgcgggaagagcatacctgcagaacagttgtctacattcgtggcacctactttggtgtacggatgattaggtttctaggagtgcctttgcgatagctcacg

SEQ ID NO: 7492 - DNA, 67 bp, Zea mays
cgaccacgccgaagtcaccgcgaggggcagcgctgaccaccctcgcgtgcgacactccgcgcaaaag

SEQ ID NO: 7493 - DNA, 104 bp, Zea mays
aaggggagcagagcctgacgtaaggcctcggggccacgcgatctctgcatttattgtggagatcgcgcgccgcctgaccgccctacgggcaggcgatgcgccga

SEQ ID NO: 7494 - DNA, 75 bp, Zea mays
gatacccattgtcatatctaactcactctaccaagccatgtaccgagctgacgttgacgatgaccggtgccgttg

SEQ ID NO: 7495 - DNA, 102 bp, Zea mays
tttcacggaaagcgtcagcatgttgcgtccaaagtctctggacttcggcagacacagctgccgtgagagcccccgatgcagtacgactggcgaagtcggcca

SEQ ID NO: 7496 - DNA, 88 bp, Zea mays
ccgggtctacgggctgaacgggccgtgcctagagagcccacgtgtctggtcgttggcccaggcacggccctctgggccacttttcgtg

SEQ ID NO: 7497 - DNA, 101 bp, Zea mays
gggcgtgtgtgggttaggggttcgggtatatggtggatggcgcatgtgggtccagagtggtcacatggcatgacatatgatgacactattcacacagacat

SEQ ID NO: 7498 - DNA, 79 bp, Zea mays
gcgggtccgcgaagctgctgggtggcgtactgtatcttagccacatctgaacaaactccattaagcagtgggaatttgg

SEQ ID NO: 7499 - DNA, 110 bp, Zea mays
actaggtgagtgcccgtgcgttgcaacggaaccgtatgataacacgataacttatgtatataagtgtgttatagtacgatgcccgtgcgttgcgacggcatacaaattat

SEQ ID NO: 7500 - DNA, 110 bp, Zea mays
agccagatttggcgcccatctatctcccgatctagggcgtatcatcccttggaactcacacatgtgagatagccctaggtgccaggaggaggtctgcgccggattcatgg

SEQ ID NO: 7501 - DNA, 210 bp, Zea mays
tcgctgtcattggttatttggagccctaaagagatccgaacggctggcgtgccgataacatggtagaacacgtcggagggcagggactcgcctctggcggcagcctagagacaatgcgtcggcttcttcattcttggcccggtccacatgctgcaaggtgaatcccttgaattatctctcgagacttcggatggccacgaggtattgcat

SEQ ID NO: 7502 - DNA, 74 bp, Zea mays
aaggaagaacggagcggctctgttttttgtttagttgcagagtgaactggaacaaagcggctctgttttttgtt

SEQ ID NO: 7503 - DNA, 126 bp, Zea mays
aaagggggcttctttgccgagtgctaggaccacatcactcggcaatgaggctttatcggttcccaggtgtgctctctttgccgagtgttgtggtcattgcactcggcaaagacactctttgcctag

SEQ ID NO: 7504 - DNA, 154 bp, Zea mays
ttcttcatttagggcctatttggtttgtggctaaatgtgtcacactttgtctaaggttagtcgtttgaattgaataactaaccttaggcagaaaagttaggcaaagtgtggcaactgaggtagtgaaccaaacaggcccttaatctttcttcca

SEQ ID NO: 7505 - DNA, 88 bp, Zea mays
gaacaactcactgtggagctcggtctacgttcaccggcgatcgggtgaagtccggcgagcgtggactggcttctccggcgaggcaaag

SEQ ID NO: 7506 - DNA, 70 bp, Zea mays
aaggccattccggaaagttgatgagcagccagttgaacacgctggttttctgggcatccgatggcttcta

SEQ ID NO: 7507 - DNA, 148 bp, Zea mays
ctaggtcagtgcccgtgcgttgcaacggaatgatataataccacgataacttatgaacaaatgtgtattatactgttatgagatggaggatggcgttctcgagctgtccgggatgaagtcgaagcgaaactcgggcaacggtcgagtg

SEQ ID NO: 7508 - DNA, 183 bp, Zea mays
gcatctcaggcgggactgcagcaatgagggcatccagcgctcgtcaatccttgtattagtcgacgtcgtcgtactgaactgcttcccacatatgtcgagctctgttgccgccgcacgtgcagccttcgccgcctccgctgcttctacttccgcccccactgctgtcagttccgccgccgctcg

SEQ ID NO: 7509 - DNA, 259 bp, Zea mays
cgtggttctatccgaagccatctgccatggaaagagagtcaatattatgcacatgctattttttttaactagttattttattcattacatcaagccattacataacacaacaccctgctaccacaagctcatcacacgcgagtgctatctagggtactcccgaactccttctctaaagtgtccccaaagaccttgagaaggtcatcaaggctggccagggacatctcttcggtgtcggatgagttccgatggaggcctt

SEQ ID NO: 7510 - DNA, 250 bp, Zea mays
tctccaacaacgttctctaaatcacgtactctatacgcaaatacttatattagagacatttttaaatttttaatttttgtacatatttatttgtcatactctcaaatgtattgtacatattttaattttgctaaaccagttgggtaaagtattcaaatgcatagaggaccgtttaaagaaactctatatatagagaatccaacagcgtcctctaaatttagaggactgtttagaggacgatgctagagag

SEQ ID NO: 7511 - DNA, 194 bp, Zea mays
aagtctgcacgggtactgttggttgcaatgtagtgatgaaatagttagattgaaaataacaaaatttatgtaagactaagatcacaaattaattacgaaacattttcacataacagtataacacacatttgttcataagttatcatgatattaaatgtttccgttgcaacgcacgggcacccacctatatgtgt

SEQ ID NO: 7512 - DNA, 83 bp, Zea mays
ttgccaggggcgagagggaggctgtgcactggactcaaccttaagctggttccagtgcaccacccctctcttgctcatgtcac

SEQ ID NO: 7513 - DNA, 77 bp, Zea mays
acttgattttagactcagctagtgcttttggcaaaccaaacccctcagccaaacagctacatggtctagaggtagag

SEQ ID NO: 7514 - DNA, 150 bp, Zea mays
cgtgttcatgtgctcgatgttcgcttagcaggacatgcaaaacacttaagcccttcctcatcttatgatttagggtgggtgcactacaccatccggcccgagaattccctctccgacacattgttaggctaactccagcaacgttgtgaa

SEQ ID NO: 7515 - DNA, 89 bp, Zea mays
ggtttgggttcggggattttctcggccggaccaatgtttccgtctcttcttaatataataccggatgacggttattccctccccgaccg

SEQ ID NO: 7516 - DNA, 78 bp, Zea mays
tgtctcgaccacagcactcggcaaagaagctttaccggttcccaggtgtgccttttttgccgagtgctagggccatga

SEQ ID NO: 7517 - DNA, 142 bp, Zea mays
agccctggccgcgaatgggggatcgatgtggacgtttgacatgtgtggggacggagtgccctgacatgtcgtgtgtttaggtttaccttgcaaggtttaaaaactcgattcgaatcgtctgcttctcgcaactaatgagact

SEQ ID NO: 7518 - DNA, 162 bp, Zea mays
ccttagtctagtctttgccgagtgccaccagacaggcactcggtaaagaagcctttgccgagtgctagatcaaaggaactcgtcaaagtatatttgttaattttaaaaaatctttggcgagtgccagatcgcgggcactcggcaaagacgttaattatacag

SEQ ID NO: 7519 - DNA, 192 bp, Zea mays
tgctgggaatatgggcccatttttcgggccagcacgagcacaatctgaaaacaggagattaaagcatggctcgacacgaaataatatggattgagttagcatgcccgaaggcggatctaggctaggcctcaaattccggcccgtcggactcccggcatggcctgcatagatgggccggtcttggcccggcac

SEQ ID NO: 7520 - DNA, 151 bp, Zea mays
ctcgaaatcttaaggccctgttcggttgttccggattggagccacggattaattcctagccggattacttctctaatttatatagattttgatgagctggaatgaatcctggcttattccggtacaaccgaacgggccctaaatcgattct

SEQ ID NO: 7521 - DNA, 196 bp, Zea mays
ccaatgggtcgagcctgacgtaaggcccacgcagccgctcgacctcagcatttattgcggaggggacgcgccgcctaccactacactgacaggcgacaagccctcttggaaataaatgtgccttgtccaatccgttggcaggcggcgtcagggtcgtccaataagcggcgggcctcacttacgtttgacggattgt

SEQ ID NO: 7522 - DNA, 104 bp, Zea mays
ggctagtttgggagtctaaatacgagaggggattagaggggctaaataaggaggggattttagcccttccgaccccctccggttttgtggctcccaaactagct

SEQ ID NO: 7523 - DNA, 246 bp, Zea mays
atcttcattgagctgaacgatcccttggggcacatgatgttctcagaaagcagcttcaaattctgcctaggtagcatctctgacggcagcgctgaaggtatcccatcaggatagggccatcccggaaagttgatgagcagccagatggacacgctggttctcagagcatccaatggcttctaacttcctttttgtcatgcgcagccagtcatcatcatcgagtggattgctggacttagcgaatgt

SEQ ID NO: 7524 - DNA, 247 bp, Zea mays
gggcgcaccggacaccgcgcgatgtgcggtgctcttccggccgctggaccctacctcccgctgaaccgattccagggttggcgggccgttaagcagaaaagataactcttcccgaggcccccgccggcgtctccggacttcctaacgtcgccgtctgccgccacgtcccggctcgggaaatcttaacccgattccctttcgggtgacttttcttgatcgcgctatctgccgggtttcccccgtccct

SEQ ID NO: 7525 - DNA, 73 bp, Zea mays
actcccgtcggcctactctctggccgacgggcgttatgttattctcgtcggcttcagtgtagccgacgggagt

SEQ ID NO: 7526 - DNA, 145 bp, Zea mays
gagagtaggcctccaaaatcgccgtccgcagagagacacttgcacggatgtgcgggcgaccaggttctcgcgactgctcacttcgtccgctcgtccagtgctgatcaagttcctcgtcgccggcgccgtttgagggactgcacta

SEQ ID NO: 7527 - DNA, 79 bp, Zea mays
gtgtcagtcgggcgacacccggcaaagaatattttaaaaaataaaatagtctttgccgagtgcttgtcagtgggcactt

SEQ ID NO: 7528 - DNA, 216 bp, Zea mays
cgacaagaagctctttgccgagtgccacgcaaaaaacactcggtaaaagaaaacactcggcgaagagtttctttgccgagtgttatatttttggcactcggcaaagggctctttgccgagtgtcaaaaatacaacactcggcaaagaaactcctcgccgagtgttttcttttaccgagtgttttttgcgtggcactcggcaaagagcttcttgtcg

SEQ ID NO: 7529 - DNA, 120 bp, Zea mays
cactaaacacgactgagtgcagggcgactgggtttactcctttccgccttctatacggatcggaggccatttccccgcaggaaataaagcatgggtccccgcgaacagttccgtcagccg

SEQ ID NO: 7530 - DNA, 118 bp, Zea mays
ggacccttaccttggcgccgttatcattggcgcccacgtaggacaagtggcgccaatggtactggcgtcgatgtgtgttatctcggcgccaatgatgatgacgccgaggttggggtcc

SEQ ID NO: 7531 - DNA, 155 bp, Zea mays
gtgttttttaggcactcggcaaagaagtttcttatcgaatgccaaacaaaaaacactaggtaaaaaaaacactcggcaaaggatttctttgccgagttttttttttatttttgacactcgataaaaagcttctttgtcgagtgtttttttcaaca

SEQ ID NO: 7532 - DNA, 220 bp, Zea mays
cggaatctggctctttgccgagtgtctagatctttgtcgagtgctatttatcgggcactcggcaaaacagactttgttgaatgctacactcagcataaaatgacactcaacgaagagagtttctatcgagagccaaactctcggtaaagacttctttgccaagtgcccagtactcaacagaaatagtctttctagggaactcggcaaaggctccatcacc

SEQ ID NO: 7533 - DNA, 127 bp, Zea mays
taaccttatctccgacggctcggtacaaggccgtcggagataagcgctatttccgagagccggttgcggccgttggacataagcttatctccgacggcctcgtacagggccgtcggagataagaagg

SEQ ID NO: 7534 - DNA, 134 bp, Zea mays
ccccctgacttctattccttcttccccgtggtccctccccccttttgaacagtacccgtgaaaggaaaaagggcggcgcggcttacctgcggcgagggaggtccggcgaagggtggggttggcttcgggaggtt

SEQ ID NO: 7535 - DNA, 211 bp, Zea mays
actaggtatatgcccgtgcgttgcaacgggtgacatttgtacacgcatagatcattgtttagtgatgttatcaactgatgggtcacacttgtgtatgcataggtcattgtttagtgatgttatcaaccgaattctgcgtgtcaggttgacacgcgagggagatggcatcgggaggcaggctcgggggcggggcatcgggtgtgtgcgacca

SEQ ID NO: 7536 - DNA, 235 bp, Zea mays
aaaaaggaagacacgaaaggagcgagctggctggcatctgcatctgctcgacaaaagggtaatgctctatgaaaagagcccggagattcttggagtatttcgagtatagtacatgtacttagcactgtagtgtagtaacactttgcgtcgagagggagaatagaacgtgttggatttagggctggacaaaatactcatggcttgtgagctcgctcgactcgtagtcagctcggct

SEQ ID NO: 7537 - DNA, 153 bp, Zea mays
agcatgtcagtcttttgactgcaaggacagcgtgctgcaggcatctccttttgacctttttaacttttggactacagcagcttgctgcagtctttcttttgactagagtacaacagcacctctgtgtagtgcagtctgtaggacagcgtgttc

SEQ ID NO: 7538 - DNA, 231 bp, Zea mays
taagaacgtgggtaccgtcgaacttaatgtgcagccctcgcagacccacgcaggacatataagttcgacggccacgtggccccgtcgaacttaaccgtaataacgtgggtcccgtcgaacttaggggaaagattcgacggccctcgcagaacttaaaaatacatgttcttactataaagatagaagatacccaagttcttaatgttaagttcgacggtacccacgttctta

SEQ ID NO: 7539 - DNA, 92 bp, Zea mays
accggccctagggcggttgaaccggcccgggggcaggcggccgagctggggcggccgagcgcggggggcggccgagctggggggggggggcg

SEQ ID NO: 7540 - DNA, 140 bp, Zea mays
gcgggtatatggttccccctgaaagctaccttgaactctctccattccacttcatggtcagctggatgcatagcaagatagtggtcccaccatgtccgcgcgggtccgcgaagctgctgggtggcgaacctgaccttagt

SEQ ID NO: 7541 - DNA, 144 bp, Zea mays
cgggcgcactgtttgacatcccttggataggtgcgccgtctgcaggatggccctggctctgcgtgccagtggagtggacaggacacattaaatgccgagggggcacatcacctgtcagcagggtggacagacggcgcgtcctct

SEQ ID NO: 7542 - DNA, 104 bp, Zea mays
cgggcagggcgcaggctgttgatcgcttggatgttggattggatttggcctctggtcgtagcctcctggcctcctgggccgtaggcggcactgcgacaggccgc

SEQ ID NO: 7543 - DNA, 94 bp, Zea mays
gaatttgtcccagcccagaaccggcacgacccggcttcaatcatgcctgggctagcccggcccattcgccgtgtcggactgggccacagaaatc

SEQ ID NO: 7544 - DNA, 169 bp, Zea mays
gacccgcaagctggcactcggcaaagggagcttctttgccgagtgcctgactgccttgcactcgacaaagggatcaccagtgggcccctttgccagcctctttgtcaatgcgccctgggaggcactcgacaaaagggagttttttttgtcgagtgccagaactgcaaca

SEQ ID NO: 7545 - DNA, 149 bp, Zea mays
acaatccttaggccttgttcgtttgtgccggattggtgggtcggaacgattcctaaccggattgcttctctaatttatataaactttgattagctggaacgattatgggtgcaatccgacacaaacgaacaaggccatgttcgtgtacc

SEQ ID NO: 7546 - DNA, 68 bp, Zea mays
agagagctaccaggagtaagtaccgccggtccaaggattggacggggtgttacaagtggtatcccctc

SEQ ID NO: 7547 - DNA, 105 bp, Zea mays
tatggaggagtggtggtccggtggcgcaacctatgaggcagttgggtccgacggtaaaggagaaatttgtgtcaaatgtgtgtgacctagctaccctactgtgct

SEQ ID NO: 7548 - DNA, 102 bp, Zea mays
gaaaagccaagaggccgccaaggcggaaggtgccactgcctcctagaagctaaattcttggagcccagtggccttaccccagcggggctctcaaatggtggt

SEQ ID NO: 7549 - DNA, 79 bp, Zea mays
gctccgttcatggaacacggggttcttggccaatgccagagcgtactggctgtccaccctgagtttccaacgctccagt

SEQ ID NO: 7550 - DNA, 101 bp, Zea mays
tcctcatctcaggacttagggcgggtgcactccaccacccggccggggatctactctccgacaccatggtagatgtgtaaatgttttaggtatttaggaag

SEQ ID NO: 7551 - DNA, 188 bp, Zea mays
ctgcaaactagaatgtttgcagtccctcacaaaaaaagaggattgaccacacctgtaggttcaccagataatgttttagttgtgttaatgctgctgcgggtggggccaaatctctttttttagagcgctgctgcgggtgaggtcaaacttttttttttgtgaggggctgcaaacattctggtttgcag

SEQ ID NO: 7552 - DNA, 123 bp, Zea mays
tcatttgctcggcgctataggctatggcgtcgaagtacgtgctgcgctggcacaaacggacgtcctggtgccgatgtggcaccaagctcggcgccatagatcttggcgccaaattcgagtggg

SEQ ID NO: 7553 - DNA, 113 bp, Zea mays
ccagtttcaacggtcgtcgtgcgtcatcattttacaaataacccctcacaactatttcaaattaatctgttgcacgtctatagatggccaaacggcggtccggcacgggccag

SEQ ID NO: 7554 - DNA, 217 bp, Zea mays
gaaggcttgcgcatactgcagtaccgtgcgggttccttgattaagggccagaaattcattcaacttctgatcaagaatgccagctgggatgtggtgtcctctgaaggcagtcttgaattcctcccaagatacttcacaatcagcggggagcatagcacggaagtggtcccaccaagtctgagctgggtcgcggagctgctgtgcggcgaagcgagcc

SEQ ID NO: 7555 - DNA, 147 bp, Zea mays
agtgccagatctctggcactcggcaaagtagactttcccgagtgtcagctggttgacactcggtaaagattcttttagaattctttgccgagtgtcaaccagctgacactcggcaaaatctactttgtcgagtgtcatttatggaca

SEQ ID NO: 7556 - DNA, 136 bp, Zea mays
agtactttttgtagggcactcggcaaagaaaagtcgccgtcgaggtgctaggtgacctcggcggaaactgtgccaagtgccacacggacacttggcaaagactcactctttgccgagtgtctactgtactggcact

SEQ ID NO: 7557 - DNA, 191 bp, Zea mays
atttagagggtgtgtctggttttatggactaatttttaatcccttcattttattctattttagtctttaaattatcaaatacaaaataaaaatagtgttttagtttttatatttaataatttatggactaaaatagaataaaataaaataactaaaaattagtccctagaaaccaaacgtacctacagttt

SEQ ID NO: 7558 - DNA, 186 bp, Zea mays
taaacggatacgaattcggaagctcgacctactcttacgattttatcccgggcaaattaattgaaactcggcggcaaaagtgttaatacaaaattaaatcggactacaaccggaatctaagaaaaactaggcgtagaattataaactgagccgttttctagtcgactccgatatcgtttagcttga

SEQ ID NO: 7559 - DNA, 82 bp, Zea mays
ttgccgagtgccagctggatgacactcggcaaagaatcttttataatcctttgtcgagtgtctccctgctggcactcggcaa

SEQ ID NO: 7560 - DNA, 164 bp, Zea mays
aattgaaattcataaagtagcgcgtgcatctcttgttgtagcttcttagctcggctacgtgtaattggtccatcaaagacttgggttggtgatggtgttggttgtacttgagttgatgtagtatgacttgggggttgtaacgtgttgcttaatggcgtggtcat

SEQ ID NO: 7561 - DNA, 154 bp, Zea mays
tgtggcttgcttgcacgacggagagtgtgggagatgcgctggcagacgctcgaggcagccttagtggtgaatggcctcgacacacggggacacgacctcgccctgtcgggcaacgatcagcagccgcgctggcccgctgtctccaagtgcaagc

SEQ ID NO: 7562 - DNA, 135 bp, Zea mays
ggaagacgaacgtgacgtccgacgacggcgaaaacgatggtacgtgcatgttgtaaaacactctcgtgaacgtgcatagcccactgcgcgggtcggtgttgaggctggtgtcggacgaatacggagaggaggcgc

SEQ ID NO: 7563 - DNA, 68 bp, Zea mays
ccactgcactcggcaaagaacctatatcggtgcccaggtcttggttctttgccgagtgctatggtcct

SEQ ID NO: 7564 - DNA, 78 bp, Zea mays
gtgatagctttgcgtgttgtcgagccccgtcgtgttccttgttttcactcgtcggccgacctcgccacgacttagttc

SEQ ID NO: 7565 - DNA, 205 bp, Zea mays
ctggttttatcccttgtcttacggctccgtccccaaagaagctaccactggtcgacccctctcctggtctataaaagggagggcttggtctcgaggcaaaggggacgcttcagaagacaagcaaacaaccctggacgccttcaaacggaacacccgcaaggacgagcaggaggaggaggagcgtcgacgagggcaaggaggctgg

SEQ ID NO: 7566 - DNA, 259 bp, Zea mays
ttctttgagatttgtgcggccaaacacgtggcgttaatcaagacaagcctgtacagacgttactttgcaggccgctgcagccaatttttttccgtgttgaaggggtccaggcggaggtagatgggccactggagaggcccgttctcaccttgccccgaccttttttgtgtggtgggcctctggacttggtgcggctgggcccgcctctgcagagagatgcatcatgtccgcgtgaggggcctgttcaggtttcatccct

SEQ ID NO: 7567 - DNA, 86 bp, Zea mays
gtggcatcgcctccaccgccaattcgctcgtctccggctccgcgggggacggtgctgcgcggttgtggtgggaggggcatggcggg

SEQ ID NO: 7568 - DNA, 81 bp, Zea mays
cttcacttcccgctcaggcggagacccgctgcttgtggcccatgacattagccatcgggtcgagcctgacgtaaggccgtg

SEQ ID NO: 7569 - DNA, 202 bp, Zea mays
ttctagagtctgtcgtaggaagttagcgcctcgtttgaccacacccgcggatcagcaactaaaagctaacttcctagaggaggttgtagaaagttagttgtccatgctaacttcctacgaccgcctctaggaagttagcagctcgcttgaccgaacacatgggtcagcatgtgaaagctaacttcctacaacttttataaaa

SEQ ID NO: 7570 - DNA, 152 bp, Zea mays
gtcgtaagctggcactcggcaaagaaggtccctttgtcaagtgactgcctgtctggcacccggtaaagggagctccagtgcctcgcccgcagtcgagtgctctagctgacactcaacaaatagagcttctttgtcgagtgccaggaccatag

SEQ ID NO: 7571 - DNA, 146 bp, Zea mays
tgcatcagacatgggtggtgcgatccggtcgacgtttggtaactgcaaaacagaacatacaagaggtctcatgtgtattggaatctcttttccaccaccaatctctaatttcatcgtctccgggttaagcttccgtttcagccagc

SEQ ID NO: 7572 - DNA, 152 bp, Zea mays
ccacaccctcgacaaccactacgatgagctctcctcccactgtacccacctaaactccctagtggaaagcctagagcagcaagtcaaagagcttaagcaagagaaggcatctctccaggagagtctcagcctagtggaaggcgaggaagcca

SEQ ID NO: 7573 - DNA, 104 bp, Zea mays
attttggttgtctgttattatgccatcacgtgtctatgactggtgggaccatctatgtctatgatttgtgggcccgatggcatactggcgaagcccacaaatta

SEQ ID NO: 7574 - DNA, 74 bp, Zea mays
aggcactttcgtgtattttgatccagccttgaaccctattctctgtgactgcgtcgagctccaccctcagacgg

SEQ ID NO: 7575 - DNA, 167 bp, Zea mays
ggcggagatgctcgtcggcggcgaggagtccggcctaaccagggcgcgataggtcaattgaacggttcagagagcttcactgggtgctggggaagacgtgggtgcaaggaatttgaagatgacttactggttagctcggttcacgcgtggcggcgggtgaccgaagt

SEQ ID NO: 7576 - DNA, 90 bp, Zea mays
ctcggcactcggcccaggcacggcactagccatagagccgtgccggcacgagcccggctccactcgtgtcgtgtcgtgccgtgctccgag

SEQ ID NO: 7577 - DNA, 76 bp, Zea mays
cgatgatggcggggattcctgagattgcgcgtggggaggacgatgatggcggggattcctgagattgcgcgtgagg

SEQ ID NO: 7578 - DNA, 84 bp, Zea mays
cacaatcgtttggtgcacggttctgccgaggttgccgaggatccccaccgtcctccccacgccgatccggcccaccctcctccc

SEQ ID NO: 7579 - DNA, 187 bp, Zea mays
aagtgtggttgccgggttccggtgccaaactgcgcgctaacctagagcccacaaaggttacggtcgattaagacagcaggacggtggtcatggaagtcgaaatccgctaaggagtgtgtaacaactcacctgccgaatcaactagccccgaaaatggatggcgctgaagcgcgcgacccacaccacg

SEQ ID NO: 7580 - DNA, 74 bp, Zea mays
cacgcgatcaggctgcgttggtaatcgactgagttatggcattagttgaatattgactgcgctctggcacacga

SEQ ID NO: 7581 - DNA, 188 bp, Zea mays
aactcgattcgaatcgtctgcttctcgcagctaatgagactgcttgattccttgtactgcatcgagtaagaagtgaaatgtggattatatgagataacttgttgattgaactaattgattgttaccatgtatgcttagaaggagcaaatctagcttaagttatggatagtagaaatttgaaaaagcta

SEQ ID NO: 7582 - DNA, 204 bp, Zea mays
gaatccctccgaccacggcgaacgtagaccgggtaagccacagcgccatttttcgattcaaggcacagctagcctctacatcaccccgtgaagctcaccgtgccattggattggaccagatcgccgtgatttggcaggcacacccgccaccgacgaggatacccgcctgcgcacgtggaccgagcgattccgaccatccctgcc

SEQ ID NO: 7583 - DNA, 84 bp, Zea mays
tatatattcccgttgcaacgcatgagcactcaggtagttagtacatatagcttcagagtttttagagttgtccctgcatagctt

SEQ ID NO: 7584 - DNA, 71 bp, Zea mays
gcgagattgctccggtgaagtggtcgaggcgaaaggggaggtcgcggggatcacaacagtgtgcggaacgc

SEQ ID NO: 7585 - DNA, 202 bp, Zea mays
cctacacgtagggggtgtttggtttctacggactaatttgtagtcccactattttattccattttagtctctaaattgccaaatatagaaactaaaatagatagagttttagtttccgcatatgacaatttagatactaaaatagaataaaatggagaaattaaaaattagtctctagaaaccaaataccccgtaatctcca

SEQ ID NO: 7586 - DNA, 76 bp, Zea mays
tcagggtcatagcactcggcaaagaaagaacacctgggtaccagtaaagcttctttgccaagtgttgtgaccctgg

SEQ ID NO: 7587 - DNA, 171 bp, Zea mays
cagtgctattcgggccagcccggcacgatcgggcctccaccgtgccgtgctcgggtagcaatctgggcacgtcgggcggcccggcccggcacggttaagtgatcgggcctaaacgtgccgggctcaatcgggccgggccaagtcgtgctcgggccgggctgggctgcccat

SEQ ID NO: 7588 - DNA, 212 bp, Zea mays
gcgcaacagaaccgtccagaagaaacagtcatatcttttgattcccaaaagctatgaaggcccataagtacatatagaaaagctcttgaagtctagtttacaatgcttctaaggccgaattaatcaaatctaccagaggtcagccgacctactcccatgctgactggtcagaaggtcaacagtctgtttgttgagggcgttttcgtattaaa

SEQ ID NO: 7589 - DNA, 112 bp, Zea mays
cgcagtcatcccgagggaattcagcgaagggtatctcttatttcgtccgaacagctcggacagagtccagtgtcaagctggagcccaagcgcgagggccctttcattgtcaa

SEQ ID NO: 7590 - DNA, 120 bp, Zea mays
aagaggttacctctttgccgagtgtctaccagcccgtactcgacaaagggtctaccagtggggcctttgtcatcttatttgtcgagtgctctaggagacactcggcaaagcttgcttctt

SEQ ID NO: 7591 - DNA, 258 bp, Zea mays
ggaagatgatgtccgcctgactgccgttgtcaactaggactttgtgcaggtcccagcctgccacgctgcaattgataaccatggcgtcgcagtggggggcgctgcgcaggtcgacgtctcgtgcgtcgaaggttagcggtatgtgggaccacttttgtctgcacgactgggccagtgacggcgacatggttgatgctgcggtagtggtcccgcttctgccgcttggtgtcgaagtcagtgctggacctcccagttatc

SEQ ID NO: 7592 - DNA, 175 bp, Zea mays
gagtgtgatcgagcaggttagcgcgagctttggccaccagcaagcgcagtatcgacgacgaggatcgaggcggggttgactagcacgacaagcccgtgcagtgggcaagggccaacggtcgggagatggcagcacggttcaggcaagcccgcgcaaacactgaacgagaaaaacg

SEQ ID NO: 7593 - DNA, 84 bp, Zea mays
gggtgcgcagaccaacgacctccgggcagaactcaaccgcaggcgtgcgggagaggatgcccgggtctctttggaaagggcgcg

SEQ ID NO: 7594 - DNA, 258 bp, Zea mays
cccactggatgctcttcttcgacggatctgcccgccagcagggtggctgtgctggagtggtcctcctctacccaagcggagatcaagtgaagtacatggtgtaccttgagttcaaggccaccaacaacatggcagagtatgaagcacttattttcggcttgtctgcgaccctatccctagggatctgccagctccttgtgaagggggactcccagttgattatcaagcaggttcgcggagaatgtagctacaacgaac

SEQ ID NO: 7595 - DNA, 86 bp, Zea mays
cagacccccatgcggaggtgccggaccccagtatatacagatcgggcctccgagtaaggtccaggacctccacaggcgcaaaccgg

SEQ ID NO: 7596 - DNA, 83 bp, Zea mays
tgcctaactgtgactgtggcagactggcttgggtacatcaatcacaacatccatacacggctgctcgctgctactacctttgt

SEQ ID NO: 7597 - DNA, 160 bp, Zea mays
cggctgtgcctgtgcagccgtgcgggtgcggctcaacgggcagcggctgtgctgcacacagagaaccctaatctcttagtgggctgacccaaggtattgcccaggcaataccgggccatactgggccctccgcccctgccactgcgcatagcacctttcg

SEQ ID NO: 7598 - DNA, 75 bp, Zea mays
caagtggtatcagagccgtcccccacgctttcacgggtgtgtttgggttaggggttcgggtactggtgcttggcg

SEQ ID NO: 7599 - DNA, 71 bp, Zea mays
agagcttggcgccatagactatggcgccgagatgtgttcgctcggcgccatatgctatggcgccaagctag

SEQ ID NO: 7600 - DNA, 101 bp, Zea mays
agtggtccctcttctgtcgcttcatgtcgaagtcgacactggacccccagtgatcatatgaatgactccgcgatacggctgatcggcgaagtcttcttgct

SEQ ID NO: 7601 - DNA, 80 bp, Zea mays
gtgccttgccaaggcactcggcaaagatgggtttgccggttcccaggtttccttctttgccgagtgtcatggtcagcact

SEQ ID NO: 7602 - DNA, 76 bp, Zea mays
tgctgaccatgacactcggcaaagaaggaaacctgggaaccggcaaacccatctttgccgagtgccttggcaaggc

SEQ ID NO: 7603 - DNA, 92 bp, Zea mays
gacggaatttaggggacgctgctggagacagtctttatttagaggatgaggtcgtcctctactcactccagcagttttctctaaatagtact

SEQ ID NO: 7604 - DNA, 68 bp, Zea mays
gtggcgcacccgacagcctgtttgggcgcgctggttgaacgtttgaaggggtggtcggcctggacttc

SEQ ID NO: 7605 - DNA, 75 bp, Zea mays
ctttgccgaatgttttatttcgggcactcggcaaagagctctttgccgagtaccacgcaaaaaaccctcggtaaa

SEQ ID NO: 7606 - DNA, 93 bp, Zea mays
tttccgccggttcgtcgtctgcggggtggaggtcaacgggagttcatcgattcgccgagagatcgacgctcagccgatctgcgtcattcgagc

SEQ ID NO: 7607 - DNA, 151 bp, Zea mays
agggagacggcaacggaggagggttgaggccaagtgaggtgaaccctcgataggggggagggggggaggcgaacggacctcatagggcgtggtggaaatgaggggccgaccgaggcgcttggcgatctccttcttctgttgctgcgccttc

SEQ ID NO: 7608 - DNA, 84 bp, Zea mays
cgagtgcccgtgatctggcactcggcaaagttttttttaatttttaaaataaactttgccgagtgccagatcagtggcactcgg

SEQ ID NO: 7609 - DNA, 111 bp, Zea mays
gttggggctccgcctgagcggggagcaggagtgtatgcggataggtccggagcgcactagagcaggtctggacacgtgtcagctccgggcccccgcttaggccttaagtaa

SEQ ID NO: 7610 - DNA, 185 bp, Zea mays
aatttacataactattggagttgctctaaggccctattaccaagagatgaacccgaataagtggagccaacagccaagtattcagaacaggttaacatcaatagatacgtggatccaacattgaagtatcacagaacaggtcgacatcaatagtttcagcggagtaaaccaacagagattggtgg

SEQ ID NO: 7611 - DNA, 132 bp, Zea mays
agtattctaggtgacactcgacaaagaggttaccagcgggcccctttgtcagtatctttgccgagtgccaaggcaaagaagctttatcggtgcctaggtcttccttctttttcgagtgctatgatatggaca

SEQ ID NO: 7612 - DNA, 70 bp, Zea mays
aggggtagcagacacgctcgaacagtatggctatgtgcgcggaccgtccgagtatgtcaccagactatcc

SEQ ID NO: 7613 - DNA, 130 bp, Zea mays
gcaaaaagggagcctttgccgagtgtcatcgtggcacttggcaaagtctttgtcgccgtcacctgtcgctataacgacgacttttctttgccaagagccagatggcactcagctaaggttttgtcgagtg

SEQ ID NO: 7614 - DNA, 149 bp, Zea mays
aatagaacccgccgtccacgccaggattttctgagtcttggaaacacttacaccgagacccctgctgtttcctggaattgatgccccgtccagagcgttataaatcaagactagttaagtgcccgtgcgttgcgacggcacgcaaatta

SEQ ID NO: 7615 - DNA, 172 bp, Zea mays
ttcaaggaacacgacggtcagtcggcgagctggtaagttcggatagggatggccaaaatacgattggtgagttgagcaactccgatgatttgacgacatttaaaaatatggcgagcccagcaaactccatagtgagctgggaacagctcccgatgacctggtgggacaggat

SEQ ID NO: 7616 - DNA, 157 bp, Zea mays
agtcgtcaccgtcgtctgggcagggcgtaacatatggctgtatatatatgttttgttttttgctagcctgctattttgtctgttgatagagactctctcgcgctaggacctggggcctggtgcgctgtcgtgctatgctgggtgggcggtctcggcc

SEQ ID NO: 7617 - DNA, 122 bp, Zea mays
cggaattcaactctttgccgagtgccaaatattttgccgaccctcggtaaaagaaaacactcggtaaagaagctatttaccgagtgttttatttttgacactcgacaatgagtttctttgcc

SEQ ID NO: 7618 - DNA, 169 bp, Zea mays
ggtgtaaacgtgcaatcaagccgatctggtgcattctaatggtgattgttattttacatttaaccccttccacctaaaacttagtgactaatttacatttaaccacttccatatgaaaccgatggatataaattggatgctctggatggtttgattgcacgcttgcacc

SEQ ID NO: 7619 - DNA, 146 bp, Zea mays
cagctctagggactgttggttcgttgtctaatttgctacattttacttaatttttttatttaagcatagtttttcaattcaaacgacgactaattttatgtaaaatatgatgcagttagccacgaaccaaacatatcctagagtag

SEQ ID NO: 7620 - DNA, 151 bp, Zea mays
tagtttcgttttgctgaaatgtgatagcttgtttagctcgcgagttggctcattaacgatccgagctaagatatgtactttgctcatgaaaaaaattcaaacgagtcaatctaaaccgaactgaccacgaatcaagcaaaccaacgagaca

SEQ ID NO: 7621 - DNA, 139 bp, Zea mays
gcactcgacaaaggttgcttctttgacgagtgtcaaggccacaacactcggcaaagaggctttaccggtgcccaggtgtgccttctttaccgagtgctatgcccttgacactcggcaaagaacctcttttctgagtgtt

SEQ ID NO: 7622 - DNA, 195 bp, Zea mays
acgtcctcgcgcgagtgcgtgtcccaggtgtcagccaccacggctagtcacccggctgctccggtccgtcagtcaagacccagcactcgcctttcaccgctcccggtccatcagcacgagcccgcatgacattcacctcagccgtcgaccaccgtccctgtgctccacacctgcacaccacaagccgaccgacat

SEQ ID NO: 7623 - DNA, 94 bp, Zea mays
tttctacagcctcctctaggaagttagcttttaattgttgatccgcgggtgtggtcaaacgagccgctaacttcctacggcagactctaggaag

SEQ ID NO: 7624 - DNA, 198 bp, Zea mays
ggcacaaaagctaccccgacgatggcgagtggtcattgttgtcagtcctcctctgcgtcacctccggcgccgagatgacgccataatccttaatatagtagtcgtcgaacgcgcgcgacatggtgagtatcgataactcttggttgggctgccaaatgaagtgcaccccgtgctcatcaacgaggtagtacacctggt

SEQ ID NO: 7625 - DNA, 150 bp, Zea mays
caggttggacggtcgagtgggatgttgctccggcaggagaggagcacgaggagtagtgggctaggccttgcccatttcctcgacaccgacgacatcgattatccgctgcattttattttgtgaactcttatttgctacccaaaaactccg

SEQ ID NO: 7626 - DNA, 124 bp, Zea mays
agacgcgcacaaggcctccagagcggtggacggtagaactaagcaaacgtgaaaggcgacctaaagccgccatctcagccgagtgagcggcgaggaccggcgctgggaagctttgggatctcgg

SEQ ID NO: 7627 - DNA, 80 bp, Zea mays
actgttgattcacacaattggtcatcgcgcttgggttgaaagccagtggcgcgaagctaccgtgtgcccggatatgactg

SEQ ID NO: 7628 - DNA, 91 bp, Zea mays
aggggcctcaccagcggggtgctggttggcgatgttgtgtacctgctgctggctgcggccgtcccgaccgggttccgtctgtgaaggcctt

SEQ ID NO: 7629 - DNA, 79 bp, Zea mays
gggtgccgtcggacataagccttcggccgtcggaaatagcttatttctgacggcttagggtttatctccgacggcttta

SEQ ID NO: 7630 - DNA, 222 bp, Zea mays
gtagtggtcccgcttctgccgcttggtgtcgaagtcagtgcttgacccccctgttatcatgtgaatgactccgcgatatggttgatcggcgaagtcctcctgctttggggcatgggggatgttttgttgttgctagtgtggtggtgggggtgggggaggtacgatttgtacttcctgatggtgttggtaggcgtggtgcggtggatgcggagcaggagcgtg

SEQ ID NO: 7631 - DNA, 75 bp, Zea mays
tttagcctctcagcctggcttcacagaaacgagatcagagtccatttcctgggagcctggctgctcgtggcgcaa

SEQ ID NO: 7632 - DNA, 213 bp, Zea mays
tattttttctcatgcagtgtatgtgacttgaaactttgttaggacatagtttgtgaaagggaaatggacccaacatttcctatagtcgattttggtatttagcatccatcacaaatgattatgaacagaagctatgtacttgtctggattttgtatatcatactgtatctatttttactcccgtcgcaacgcacgggcatgtaactagtaagt

SEQ ID NO: 7633 - DNA, 95 bp, Zea mays
ttggactatactaccgctgcttttttgcctgtgttgttgaaagcgtataccatatggctgggacaggcaaaccagagacgctagccaaaggcttg

SEQ ID NO: 7634 - DNA, 127 bp, Zea mays
ttacactcggcaaaggctttgccgagtgtaacactcgacaaagaacactcgacaaatatttcatcggcaaagggttctttgccgagtgtttttttcggacactcggcaaagactttgtcgagtgtaa

SEQ ID NO: 7635 - DNA, 88 bp, Zea mays
gtgagattgctccggtgaagtggtcgagggcgtaggggaggtcttgacggtcacgccgatgtgcggatcatttcccgggatggttgga

SEQ ID NO: 7636 - DNA, 103 bp, Zea mays
ctttatcgagtgtgacactcgacaaagaagtctcggtgaactgtacatcggcaacagcttctttgccgagtacgttttgtcaggcactttgtcgagtgtcagg

SEQ ID NO: 7637 - DNA, 85 bp, Zea mays
taggccattccggaaagttgatgagcagacagttgaacacgctgatttttcgggcatctgatgcttctagcttccttttaatcgt

SEQ ID NO: 7638 - DNA, 142 bp, Zea mays
agtcttagagtctgtttggttcgctgtctaacttatcataatttgcctaacttttctacctaagattagttttttaattcgaactactaatcttaacaaagtgtagcgtaattagccacgaaccaaacatagccttaccttt

SEQ ID NO: 7639 - DNA, 71 bp, Zea mays
tttgctcggcgccataggctgtggcgctaaagtaatactgcttagcgccacaaaccatggcgctgaggtac

SEQ ID NO: 7640 - DNA, 85 bp, Zea mays
aggctagtacctcagcgccatggtttgtggcgctaagcagtattactttagcgccacagcctatggcgccgagcaaaggatctaa

SEQ ID NO: 7641 - DNA, 84 bp, Zea mays
actagattgggagccacaaaaccggaggaggctggggattgtagcccctctaacctactttggttctgtggtttccaaactagc

SEQ ID NO: 7642 - DNA, 90 bp, Zea mays
ggtgctagtttggaaaccacagaaccaaagtaggttagaggggctacaatccccagcctcctccggttttgtggctcccaatctagttct

SEQ ID NO: 7643 - DNA, 125 bp, Zea mays
cggaatttggctctttgccgagtgccatattctttgccgagtgttttttttcgggcactcggcaaagaaactctttgccgagtgtcacacaaaaaaccctcggtaaaataaaacactcggcaaag

SEQ ID NO: 7644 - DNA, 261 bp, Zea mays
ttgctcagcagagacttggtcgtccgctccgcctcgcagggttgctcggtagagacttggtcgtctgctctgcctcgcgggattgctcggcagagacttggtcatctgctctgcctcgcggggttgctcgatagagactttgtcgtccactctgagacttggttgtccactccgcctcacggggttgctcgactgatacttggtcgtctgctccaccttgcggggttgctcgagaaagacttggtcgtctgctccgcctca

SEQ ID NO: 7645 - DNA, 70 bp, Zea mays
acatcattggatcattggcgggtggctgagcctgacaagagactggctttccttggtggtctgtgagaag

SEQ ID NO: 7646 - DNA, 188 bp, Zea mays
cggtggagatggacgcaatcggacggtcgagatagaggcgggggcacggttgtgcctggtctacactatcgtcttaagtattagtagagatttaagggtttagagttgtacgatacagtctttagctgtcttttatacttaaaaaaacaattaaaaggctcttagcagtcacaattgtaaatagggta

SEQ ID NO: 7647 - DNA, 73 bp, Zea mays
ggttaattggtccgggccggcccgggcatgactccaactgggccgtgccgtgcttgggccgggccaaaaaacc

SEQ ID NO: 7648 - DNA, 70 bp, Zea mays
gcccggacacggcactaaaaagcacggccaggcaccgcacggcccgttccttttagtgccagtgccgggc

SEQ ID NO: 7649 - DNA, 112 bp, Zea mays
atttgggagtccaaaaatcggaggaattggagggtctaaaatcccccttattcaaattataaggagggattttagaccatgcaatcccctccggttttatggctctcaaact

SEQ ID NO: 7650 - DNA, 137 bp, Zea mays
gaccagccctactcacacgaagccgagccccttcctccgtgctaaccctatgctttgcaaccgcccttcgtcgtcggcgcccggtgctaggacctggcacgtctggcgcgtccgcggcgtgtggcgtagcctccgcc

SEQ ID NO: 7651 - DNA, 175 bp, Zea mays
ttagcccctatcacatcgaatgtttgaacctccgttcggggtattaaatatagtcgaattataaaactaatttctcagccgaagattaaaaagtgagacgaatctagtacagttggttgggtctatatttcatactcctatttgaaagtcaaacgcttgatatgacccgagctaa

SEQ ID NO: 7652 - DNA, 71 bp, Zea mays
aacgggcttggcggaatcagcggggaaagaataccctgttgagcttgactctagtccgcctttgtgaaatg

SEQ ID NO: 7653 - DNA, 73 bp, Zea mays
ttgcgctccagctaaaatctgattctgcttgtaagtcatgcagtggcggacccagaaattggctaaggcccgg

SEQ ID NO: 7654 - DNA, 238 bp, Zea mays
gcagttccgtacccccccccccccccccaaaaaaaaaatcaacgcacgccgtacacgcatagcatataggcataaatctaaagagaccgcgcaaaaacacctgcatgtccaaaccagtcaactaatcacgcgattattgcagcgcaaaagcgcgaccccataggaaggacgacggaagcagccgcacaaagcaagcgaaagcagaggccatggcccatgggggggggggggggggggg

SEQ ID NO: 7655 - DNA, 143 bp, Zea mays
acatcatcggatcattggcgggtggctgggcctgacaagagacggactttccttggtggtctgtgaggaggattgtcttgtcttcacaactaatgatacctttgtgtttagtcaaccaatccatccctaagatcacatcaatc

SEQ ID NO: 7656 - DNA, 252 bp, Zea mays
cataggtcatgagtgggaagcagaccggtgcccacaatgtgactcagtgccaggcgtggttaatgcagtcagtcatttatggcgggtcaatccagggccgagagtgggattcactcgagtggttcccttctgacacgctcatcctcccttgtcaggcttcgccatgtccggcctaggctcggtgccacggggttcgatcgagggcgggtccttatagggttggcgcacctgcctcttccgactgactaatgg

SEQ ID NO: 7657 - DNA, 149 bp, Zea mays
tatatattatgcctgggtgcattcaatatagagaatacacccaggtgcattttagtgctgtcatataatatatatatatatatactgtttttatatattacacctgggtgcattcaatatagagaatgcacccaggccgaacctacgcg

SEQ ID NO: 7658 - DNA, 101 bp, Zea mays
ccatgccctacctgtctgacatccacggatacttggcttgggctgtcacttaaatcagtactaggtgagtactcgtgcgttgcaacgggaacatataataa

SEQ ID NO: 7659 - DNA, 172 bp, Zea mays
caacaatcttgagaagaaggctcaagcaaatgagaataggcaagacaatgtgaagcaaaatttgggtaaagaaaagaaaactcaaacaaagagaatacatggtcgggaaactgaacacatggcaaatacatgtcccctaggtaacatttctaagcctatttcaattcatgat

SEQ ID NO: 7660 - DNA, 155 bp, Zea mays
gaggctctggcatgtgtctgggaagcggtgtccgatgaaggtaatttggaaaggagggtggtttgggtagttccggctttctcccaagtagactgccatagagcatttttccattccattttcacggtactccttccagacgtattcgggcttct

SEQ ID NO: 7661 - DNA, 71 bp, Zea mays
actttggaagccacaaaaccggtgaggattttagccccttcaatcccctccggtttttggactctcaaact

SEQ ID NO: 7662 - DNA, 94 bp, Zea mays
ggggttaggcgccatagatcttggcgcctaccccctgtacacgtggacatacggtttacagagatagactccaagatctatggcgcctacccca

SEQ ID NO: 7663 - DNA, 102 bp, Zea mays
cggcaaagcctgtgacactcgacaaagagagctcggcgaaccgtacatcggcaacggcttttttgccgagtactttttatcgggcagtcgacaaaaaaaaag

SEQ ID NO: 7664 - DNA, 80 bp, Zea mays
agctgtcgtcttgctgggttgctcgacgggcaggttggtcggcagcctcatctcgctgggttgctcggcgggcaggttgg

SEQ ID NO: 7665 - DNA, 102 bp, Zea mays
tgagtttgaatccccttggggccatgcgtattttttaattttagctagacgtcggctgtacgggggaatgagaatgagctttgcggggaggatgaatgagaa

SEQ ID NO: 7666 - DNA, 150 bp, Zea mays
ctacggttttagggtctgtttggttcgctacctgacttgctacactttgcttaacttttctgtttaaggttagttcttcaattcgaacgactaaccttagataaaatatgacctagttagtcacgaaccaaacaggcccttaatccaact

SEQ ID NO: 7667 - DNA, 199 bp, Zea mays
cacatcctagcttggcaccaagatctgtggcaccgagctaggtgtcacgtcggttgccaccttgacccgtccacgccagtggagcaggcaccttggcaccatgggtcatcgcctagctttgtatcgttgttctctcttctcgatcgtagtgccacatcctatctcggcgccaagatctgtggcgccaagctaggtgtca

SEQ ID NO: 7668 - DNA, 185 bp, Zea mays
tagcttggcgccacagatcttggcgccgagataggatgtggcactacgatcgagaagagagaacaacgatacaaagctaggcgatgacccatggtgccaaggtgcctgctccactggcgtggacgggtcaaggtggcaaccgacgtgacacctagctcggtgccacagatcttggtgccaagcta

SEQ ID NO: 7669 - DNA, 191 bp, Zea mays
tcctagcttggcaccaagatctgtggcaccgagctaggtgtcacgtcggttgccaccttgacccgtccacgccagtggagcaggcaccttggcaccatgggtcatcgcctagctttgtatcgttgttctctcttctcgatcgtagtgccacatcctatctcggcgccaagatctgtggcgccaagctaggt

SEQ ID NO: 7670 - DNA, 131 bp, Zea mays
tggcgagtgttttttgacactcggcaaagtactcgacaacgaaccatttgccgataaaacatttgtcgagtgttctttgccgagtgtaacactcgacatagactttgccgagtgtaaaaaggcctttgtcg

SEQ ID NO: 7671 - DNA, 173 bp, Zea mays
actattaggtgagtgtccgtgcgttacagacctgagtttctctttgatatcattccggatggcttgtggatattgtcatccatctcataatcgtataacacatatttgtatatatataagttatcgagatattatatgttccagatgcaatgcacgaacacttacctatctta

SEQ ID NO: 7672 - DNA, 141 bp, Zea mays
ttcccctattagggctgatttggtgactcgggatctcaagaggattggaggggattgaggaagaaattagtttatttccccctcgatcatctccaatcctctcgtgacccccttgtcaccaaatcaacccttaggatacgt

SEQ ID NO: 7673 - DNA, 73 bp, Zea mays
aaatgagccgacgggctggcccgacacagtcagcagacctgcatgacgtgccaggccgccgcttggccatcta

SEQ ID NO: 7674 - DNA, 142 bp, Zea mays
agtgttggaaaaaaagcactcggcaaagagctctttgccgagcgttgtatttctgacactcggcaaatagctctttgccgagtgtcaaaaataaaacactcggcaaagagcttcttggccgagtattttcttttaccaagag

SEQ ID NO: 7675 - DNA, 126 bp, Zea mays
ccggtgcgcctgtagttggtctttgcgcggacaggttggtgtagggtttatctcgggtagtcttttgaggaagacttcgattctgcgcacttgttgtgcttagtccggctgcacccttacgcgatt

SEQ ID NO: 7676 - DNA, 148 bp, Zea mays
atgctgccacgtggcttgttgcccgtgacgtaagccagcgagcggagcctgacgtaaggcctctggccgcgcggtctctgcatttattgcggagaggacgcgccgcttgtccaccttactgacaggcgatgtgccgcctcagcattta

SEQ ID NO: 7677 - DNA, 79 bp, Zea mays
tggagatcgcagctgttgctatcacctcttttacactaagatatcgaagaccgcaactgctgctatcaccgtttaaagt

SEQ ID NO: 7678 - DNA, 77 bp, Zea mays
catggtcatacgtggtcgtgcgcgctttccgtgtgctccctcgcacgtgacgcgcgctattcccacgtatggcgctc

SEQ ID NO: 7679 - DNA, 147 bp, Zea mays
ttatatcataagggcccgttcggttgacagggaatggaataccggaactattcctacccagattgtttctctaatttgtataagttttgatcaagaagaacaattcttggtgcattcctatggaaacgaacggacctaaggcttaat

SEQ ID NO: 7680 - DNA, 91 bp, Zea mays
gggaggtcctggcggtcacgtcgaggtacgactcgtcgacggtgatagccgatatctgttgtgccacgtgcgcaggcggtcgggctcgtcg

SEQ ID NO: 7681 - DNA, 152 bp, Zea mays
caaggactgtggcagacagcaaggactgcggcagacagcacagcagtagtcttttgactgcaaggacagcgtgttgcaggcatctacttttcattttccagcttttggaggacagcaacttgctgcagtttttcttttgactagagtacaac

SEQ ID NO: 7682 - DNA, 159 bp, Zea mays
cttgttttcatatataggcctatttggttccctgcctaacttgccacactttgcctaacttttctgtctaaggttagtttttcaattcaaacgactaaccttaggcaaaatgtggcatagttagccacgaaccaaacaggcccatatacagcacaatac

SEQ ID NO: 7683 - DNA, 72 bp, Zea mays
atgagtgttccactcgatcctaggctggctggctttctggcccagctttgatctaggtttgacgaacagacg

SEQ ID NO: 7684 - DNA, 215 bp, Zea mays
agggttactgcttccgcaggagaggacaggaggagtagcgtggccaggctcgccatgttactcggtttctcgattatttatttccgctgcattaaaacctattgttattatttctgaaactccgataatgtaatcaatattgatacttattaaatttgtggtattatgttttattgtatttctctgtgcctcaccttcgagtgagctagtagtat

SEQ ID NO: 7685 - DNA, 188 bp, Zea mays
cggcaattaagaaggttttgccgagtgtcaagcttccggtgaaaaacaatgctcgacaaagggctgtcagcagccatctataattaatggctgttaattttgccaagtgtcagacattgatactcgacaaaatatcttctttactgagtgtcacctgacaaacactctacaaacctttatgttgttga

SEQ ID NO: 7686 - DNA, 140 bp, Zea mays
aattcattcgagggctgatttggtgacaaggggatcccgggaggattgaaggggattaagggggaaatcaactaatttccttctcaatcccctccgatcctcctgggatcccgggtcaccaaatcagctccgaaagggat

SEQ ID NO: 7687 - DNA, 69 bp, Zea mays
tggacccacctatgggtccgcccctgcctggtgctcgtcaaaggcccggccggtacctagttgcaccat

SEQ ID NO: 7688 - DNA, 170 bp, Zea mays
actattaggtgagtgtccgtgcgttacaggcctgagtttctctttgatatcattccggatggcttgtggatattatcatccatctcataatcgtataacacatatttgtatatataagttatcgagatattatatgttccagatgcaatgcacgaacactgacctatctt

SEQ ID NO: 7689 - DNA, 211 bp, Zea mays
taccggaatcgcgttcttttgccgagtgtctaagacttgacaaaggccattttacactcgacaaaagctttgccgagtgatacactcggcaaacaataatcggcaaaatatttggcactccgcaaaggctttactgagcttctttgccgagtactcgaaaaaacacttggcaaaatatttggcactcggcaaagaagcaaatttctggtag

SEQ ID NO: 7690 - DNA, 82 bp, Zea mays
gactaagctgcgccgccgaggggtttaggactgcctattgaaggtggtgttgtactctatgagccggcgatgtgatatttac

SEQ ID NO: 7691 - DNA, 139 bp, Zea mays
acggcgggaacgccacataacagtgggagcacatcacggccgccgggagtcctaggaggtcttcgacttcacctcccgacacataaaaccaataatcataccagttgccccacttgttgcgggcgcagggaactagttc

SEQ ID NO: 7692 - DNA, 82 bp, Zea mays
ctcgtgtcctccggattggttcctaggctggaatgagtgggccactgtttcctggtctagaactgtttccggcgtggaatac

SEQ ID NO: 7693 - DNA, 98 bp, Zea mays
gtgttgtatttgtgacactcgacaaagagtcctttgccgagtgttaaaaaaagacactcggcaaagaaactctttgccgagtgtcaaaaataaaatac

SEQ ID NO: 7694 - DNA, 131 bp, Zea mays
aaggcaaagagcttctttgtcgagtgtcagggctatagtactcggcaaagaaggaacacctgggcaccggtaaagcttctttgccgagtgcagggaccctgacactcggcaaagaagcaagctttgccaag

SEQ ID NO: 7695 - DNA, 165 bp, Zea mays
attttcttactaggtggatgcccgtgcgttgcaacgggaagataaaatatcacaataactcatgtacaaatgtgttataatattatagaaaaaggttacaaatgtgttataatgtttaggaaagaaaacaaagccactgcctgtgcattcactgggacctgaaaa

SEQ ID NO: 7696 - DNA, 116 bp, Zea mays
ctaaacaaggctttagggcttgttcggttggaaagtggtcgaaggggattgaatccctttctagtaatccctccaattcctatgcaaccgaacaaggccttaaagaggcaatatac

SEQ ID NO: 7697 - DNA, 74 bp, Zea mays
tctcacggacagcgtcagcatgttgcgtccgaagtctctcgacttcggcagacaaagctgtcgtaagggccccc

SEQ ID NO: 7698 - DNA, 145 bp, Zea mays
  unsure (64)..(65): n = A, C, G or T
atccgagcccggggtggggtggggggtgataacgctagctgcagaagctgtcggcggtgatccnnaggaggaaggcgccgcacgcgcgcagtggtccaccctcctgcttcactttccctccctccctccctccttagcgcgcacg

SEQ ID NO: 7699 - DNA, 82 bp, Zea mays
ctctggtgcaggctctggtgctggatccggggctacctcctgagcagctccttgctccggcacgaggacctactctccgtca

SEQ ID NO: 7700 - DNA, 250 bp, Zea mays
ggttgccatggtcgtgctgcaccgggtggatctggatctgggtagagcagtggtttgaggtgcttcagatcggagaatggggctcggtagtggcagcggcagcggcggcggtggaggtgaagcctaaggagatcgccggtggaaaggcccgtccgtcgccgtcgtgcctgctttcccgcgctcactcacgtctcgtgtaaccaccgccgttgaaaccctagtcctctcgtgcaaatcggccgccgcgatc

SEQ ID NO: 7701 - DNA, 246 bp, Zea mays
ccacagcaggaggcagagcaggcagcgcagcagcagccggcgcctcaggacgacgacgaccagcaggacgacgacgaccagtagcaggacgcctcaggttcaggcggctctagttcgaggagcatctacctgcgaggccccgcgagtctcccgccgcgtcccatacttcgggacagacgaccgttgattcggccggaaggggagaggtatgtaactttatgttcttcattcttgttcatattatgt

SEQ ID NO: 7702 - DNA, 128 bp, Zea mays
taaaaagtaaaataccctttgccgagtgccggatctagggcgctcggcaaatattatttttaaataataaaaaaactctttgccgagtgccagatcgcgggcactcggcaaagaagttttacatatac

SEQ ID NO: 7703 - DNA, 148 bp, Zea mays
atcttattaagggcatatttggttcgctgcctaacttaccatactttacctaacttttttgcctaaggttagttcttcaattcggacgactaaccttaggcaaagtatgacacagttagtcatgaaccaaacaagccctaagtcttgg

SEQ ID NO: 7704 - DNA, 256 bp, Zea mays
atctcggcatcgaagcccatgtgagaacgaccacgaccggggctgagccttagacctgtgctttggcttgtgtcagacgaggggatttttttaaccacagtctgatattcgctcccacggggagtcgaactcaggacctgaggagtgctactcagaccacctaactaactcagctagaggctcttttcgcaagcatgatgaacatagaagcttctctttctcagattgtatctactatgggtgcagactagccaac

SEQ ID NO: 7705 - DNA, 152 bp, Zea mays
tgctgcagtccggttgcaaaccaaaatgtttgcagcctctcacaaaaaggagaatagatttcacccgcagaagcaataacacaactaagtgatgtctatcttcctttttatgagggactgcaaacattttagtttgcagtcggactgcagca

SEQ ID NO: 7706 - DNA, 88 bp, Zea mays
tcttgctgagttgctcggaggacctgttggtcgacagactcgcctcactgggttgctcgacggacaggttggtcggcactcggcagcc

SEQ ID NO: 7707 - DNA, 213 bp, Zea mays
ctcctatctgacacgcagtggcggagcacccattatgacctatggctaaagctatatctaaaaataatgtttggtgtagtgataagtacatactacttgcagtcaataggttagaagttcgagttctacgtgttgcatcatttttttttcttttttattcttcttcagtcatacctaattattattctgtcctccgccattgctgacacgggc

SEQ ID NO: 7708 - DNA, 142 bp, Zea mays
tagggcttgtgagccacaaaaccggagggaattagagaggggctaaaatcccctccttattcaatccctccttattcaaaattgaatatgaagaggattttagccctccaatcccctacggtatttggactctcaaactagc

SEQ ID NO: 7709 - DNA, 148 bp, Zea mays
agggctagtttgagagtccaaataccgtaggggattggagggctaaaatcctcttcatattcaattttgaataaggagggattgaataaggaggggattttagcccctctctaattccctccggttttgtggctcacaagccctaaac

SEQ ID NO: 7710 - DNA, 75 bp, Zea mays
acctcgctgacggagagtacgtcctcgtgccaaagcaaggagctgctcaggaggtagccccggatccagcaccag

SEQ ID NO: 7711 - DNA, 163 bp, Zea mays
ctcaagaaaccacgggcgcgggaaggctcgtcgactcgtcgtcacaacatatatatatgactgaaaaaaaaagctcgagttaaatgatcagactccataactcagttcggttcgaactagctcaacgaagtctcggctcgactcggctcgtgagctggctcgt

SEQ ID NO: 7712 - DNA, 243 bp, Zea mays
acgccgatcaggctgcgttggtaatcgaccgagttatggcattggctgagcactggctgcgccctggcaacatgacgcagtatttgtgtcgtacgaacttggttgcgtcatgtgattgctatatcgcactctcacttaatcggatcactcctgttaagttggacctccatcgccgagtcacatatttttcgcatgccctgtaggcactgttcgtctgtcgttatcatcgagccacaattgcgc

SEQ ID NO: 7713 - DNA, 141 bp, Zea mays
gggccgagagggggtaattgtggcagaacctccaagttattgggcccacatgcacttgtccttgtcccaaagacctcagacaaccatgcatgtgcaccagataactcaataggatctgtccgattgccccaaggacatcgg

SEQ ID NO: 7714 - DNA, 246 bp, Zea mays
ctgcaggcatgcaagctttgccgagtgccacagatccgtaataggccattagctgacaaagggacccgctaagggcttcttagaaggcgcttcctggtcggcagacactcggcaaaggtaacttctttgccgagtgtcacctaggacactctggcaaagacgccgtctccgtcactccggcgccgtgacggcggcttttctttgttgagtactgtctggcactcggcaaagtctgtgctgagtgcc

SEQ ID NO: 7715 - DNA, 121 bp, Zea mays
ggactgaaacgactgagtgcagggcgaccgggtttactctctttccgccttctatacggatcggaggccatgacaccacaagaaataaaacatgggtccccgcgaacagtcccttcagccg

SEQ ID NO: 7716 - DNA, 108 bp, Zea mays
aaatcctcacgctcaccattctctattcgatctcgtcgtccagctgaaggccgtcgtcgttcaggcaactaccaaatcgagttgtgatgtggtgagccgattcgctat

SEQ ID NO: 7717 - DNA, 79 bp, Zea mays
gttgtcgatgttccaggagtgctccaggtcctcgccgtttggcgttgtgagcctgtaggcgctgagggatgcttttgtc

SEQ ID NO: 7718 - DNA, 74 bp, Zea mays
cgcagatactcgtcagggctttgtccagtgcgcttccgctccccgctcaggcggagacccgatgctgccacgtg

SEQ ID NO: 7719 - DNA, 175 bp, Zea mays
taaatttgaggaatgaacccatgatgcaccacctcaatttggatgtagtgattctttaaaccaaaacacccccctttaattccttaaaccaaacacactctaatggtgtgtttggtttgtggagtcactctattcttcatgaggtgatgcatcataagtttattccatcaatttt

SEQ ID NO: 7720 - DNA, 109 bp, Zea mays
caggacatagggttaggttttggggttttgggcccctaagaacatgttcgtttaagtaaatcccggtcagagttagacccaattccccgtggatcagcccggtctggaa

SEQ ID NO: 7721 - DNA, 73 bp, Zea mays
gctcgttttatggtcagctcggctcggatcaactcgtttgaatttttcacgagctgagctgacatcctagctt

SEQ ID NO: 7722 - DNA, 107 bp, Zea mays
gtagtctggagaggcgtcctcagcgacggactcgggctcaagttctctggaaagggacgcctgggagggtgagagctccgtccgggctcgggaccctgtcgcaccac

SEQ ID NO: 7723 - DNA, 122 bp, Zea mays
cttgccaccgggttggactgtcgagtgggaccctgcctcggctgaggaggagcatgaggagtgatgcgacttgtatctctatctctccaattattcaccgttagtttattgccgctgcactt

SEQ ID NO: 7724 - DNA, 99 bp, Zea mays
cgtcgagtgtctgctagactagccgctcggcaaagagggttttattggacctattggctatgttctttgccgagtggctgctgtactagcgctcgacaa

SEQ ID NO: 7725 - DNA, 118 bp, Zea mays
cctgcttattaagggctgatttggtgatccaggataacgggaggattggaggggacccctcaatcccttccaattctctcgtgatccccttgtcacaaaatcaaccctaagggaaaaa

SEQ ID NO: 7726 - DNA, 210 bp, Zea mays
acgctcttctggttacgcaaacagtctctcaaacgagagcagacctccgaaatcgccgtcggtagagctacacttgcacaggtgtgcgggcgattagttttttgggaagcatactcgcgattgctcgctccatccgctcgaccaacgccgattcggttcttcgttatcgacgtcgttcgagggactgcactgcgtaaacctgtctgcatt

SEQ ID NO: 7727 - DNA, 194 bp, Zea mays
gtttccagaccgtctccgcttgggtcggctcggctcgatcggttcatttatggcctgtttggttgtctggatgggtgggcctggctcgtatctagggaacctggctcttgatagtctggccgagagcatgcaatatccctatgtttggttgcctgtatgagcttagcatggcctatgcgagatgatgtttggtt

SEQ ID NO: 7728 - DNA, 256 bp, Zea mays
gaagagggctggattgcggccgcctgcgtcgcaaccgagagccgcaccgccgccgaggctgcagggacgtcggcgccgacgctgttggaggggttggtcgccatggggtgggtgagtgggtgggaggcgagtcgttggaggaacgcagatgcaagagcggcggacacggctataccgttttactggattgaatgggcgtttcgggtccgcctatccacacgcgtcgtgacgctagcgctgcaggccgcgtgaaaca

SEQ ID NO: 7729 - DNA, 150 bp, Zea mays
attctgctccagggctgatttggtgaccggagaaatagaggagatccatgagaaagaatatatatactattcaaaattaaatagcaaggggattcctcctcgtggatcctctttatttcctttatcaccaaattaacccttagttctctt

SEQ ID NO: 7730 - DNA, 137 bp, Zea mays
atgcaattcctcggcacctccgcatcagtccccctcttcggtgtcgtcacccgcgcacctcctctgcctctcgtggtccccgtccttcccgcacctccgccgagaccctggtcctgacgtcccgactgttgctcctc

SEQ ID NO: 7731 - DNA, 160 bp, Zea mays
agcgtgcttggcttggagcaatttgggatgggtgaccgaccgaaaagtttttctcgggtgcgcatgagtgaggacaaagtgcacacaaaagactcgtgttggtctatggggacagatatatgatcctagagagctgccaggagtaagtgccgctggtcca

SEQ ID NO: 7732 - DNA, 75 bp, Zea mays
tatggcccttggcgcatggctgggcgttgggtgaagtgtgccctcgccagatgcctttccatggtggaagggtgg

SEQ ID NO: 7733 - DNA, 110 bp, Zea mays
gggagcgggccgagactgcgagggctcaggtaacattgttgtttgtttggcgtttgctatatgcaggctgtgcgtgtgtttgctgaatctgtgtgtcttgtcctaggcgg

SEQ ID NO: 7734 - DNA, 202 bp, Zea mays
cgctgtgtacgtgagttctgatcctggcacgtacatagttcgcattcggtttgccttctaaaactgggtgtgacagcgaagtcctgccttcgcactgaatttgcgaaaccgtgacccggccgcctttgtgcgtgatgctgaggacttggcggtgcggctcgtggggcgttacgtgccgaggacggaaggccagcgcagcttt

SEQ ID NO: 7735 - DNA, 73 bp, Zea mays
tgtaccttggcgccataggctatggcgtcgagatgtgttacctcggtgccataggctatggcgccgaggagag

SEQ ID NO: 7736 - DNA, 93 bp, Zea mays
aatcatccgagagagtcgggcttccgaattcgtattcgcgcgagcgacgaattttaaataatcaccggacgcaccgattttcgaaatgactat

SEQ ID NO: 7737 - DNA, 100 bp, Zea mays
ttgccgacgactcttttgcggccgtcggacataagctatttctgacggcccgtcagaaataaccttatttccgacccgttgcgatcgagggacacaggtg

SEQ ID NO: 7738 - DNA, 156 bp, Zea mays
cactatcatcctctgccaccgcaaacggtgggaatgccatataacggtgggagtcattacggccgccgagagtcctgggaggtcttcgacttcgcctcccgacacataaaccattatcataccagtcgccccacttgttgcgggcgtagggaacta

SEQ ID NO: 7739 - DNA, 83 bp, Zea mays
gggtctagggctggaaggcactcgcattctctcgcccttttcggactaacgcctggtgcgggtgcctctcggattggagctgc

SEQ ID NO: 7740 - DNA, 114 bp, Zea mays
tttgctgagtgccaaacactcgacgaacgacgaacaaggaaaagggccttctgcagccgtctatacctgacagctgttacctttgtcgagcgccggtctttggcactcagcaaa

SEQ ID NO: 7741 - DNA, 92 bp, Zea mays
catatcatagtgatgtttgtcgtttcgatttttatgttttatacaaattttttttactaccgtcgcaacgcacgggcactcacctagtaaca

SEQ ID NO: 7742 - DNA, 144 bp, Zea mays
ccttctccatgaaggccagcttgtccgaggcatcttcgtagccttttatcgcgccatgagccctgtccttcgagactgcgtcaagcttcacccacatgcgggacgccacgtgcctggaccgcttgtcttccccagagttgtgat

SEQ ID NO: 7743 - DNA, 142 bp, Zea mays
accacctaaccaactcagctagaggccctttcttcacccacctagccaacagaaacacacatgtctatgttttatattctatacttaagtttaaatggaaattgtagcaatgtacggggcattttgctagtttaatataata

SEQ ID NO: 7744 - DNA, 153 bp, Zea mays
tagcttacttagggcatgtttggttcgttaccccaattgccacactttgcctaacttttctgcctaaggttagttattcaattcaaacgactaaccttaggcaaagtggggcacagttagccacaaaccaaacaagcccttatacttatctct

SEQ ID NO: 7745 - DNA, 79 bp, Zea mays
ttcattacaacacagtgcggcacaaagctaacttaatcacacattggggtcgttggagttgtgtccactatcttcagaa

SEQ ID NO: 7746 - DNA, 86 bp, Zea mays
acttattccgtgggtcggaagcggggcaccgcccctccttttggctccaagggcccggcctcgcgggccgatccggcggaagacat

SEQ ID NO: 7747 - DNA, 86 bp, Zea mays
tctatacaagcggtaagctttttacattacagacggttcggttagaaaactgtctgtgatgtcccaggcggttcggtacgcctgtg

SEQ ID NO: 7748 - DNA, 102 bp, Zea mays
gctggtctaagtgtgtctgagtctcgtaacgttgcgtgcctccccttttatagctaaatggggacatacaagggtgctgagccccgacatgcaggcccaggg

SEQ ID NO: 7749 - DNA, 75 bp, Zea mays
aattcaaacggaccgggccggtccgaaattcaaatattatggaccttttcgggcttgggccgggccgaacggctc

SEQ ID NO: 7750 - DNA, 162 bp, Zea mays
caatgcacgtagggtagtaatggactataaattctacactataaaaattaaggaccaaattagtttcagactctattcctattaatttttgaaataaattatattaaggaccctaacttattgtgaatggatcgtgatccattaccacctctaaacacatgc

SEQ ID NO: 7751 - DNA, 155 bp, Zea mays
aacgctctggcatgtgtctgggaagcggtgcccgatgaaggtaatttggaaaggagggtggtttgggtagttccggctttctcccaggtagactgccatagagcacttttccattccattttcacggtactccttccagacatattcgggcttct

SEQ ID NO: 7752 - DNA, 75 bp, Zea mays
gaggacgtggtggagtggaccgtgttgccggcatggtcgaggactggcgggacacgcgtctggtcgtggagatgc

SEQ ID NO: 7753 - DNA, 170 bp, Zea mays
aaccggtaaagcttatttgccgagaactgtggcccaggccctcggcaaagaagatccctttgtcaagtgtctccaagtgcactagtcaaagggactggcaagggtccactgtagcattctatgccgagagcccttccatcaggcactcggcaaagaagcccccttcgtcg

SEQ ID NO: 7754 - DNA, 177 bp, Zea mays
ttgccaaagaagccttctttgccgagtgcctgatatactggcactcgacaaagaatgctccagtggcccccttttgctaaacccttcgctgagagctccgggaggcactcgacgaagggggcttctttgccgagtgcctgatggaagggctctcggcatagaatgctacagtggacc

SEQ ID NO: 7755 - DNA, 72 bp, Zea mays
tcataccggctgtagaaggcactctacggtcgcaactatgtccctacagcgcctcctacgtatcggtcccct

SEQ ID NO: 7756 - DNA, 221 bp, Zea mays
gagaagccaggccactgtcgccagagttcaccaccccgcaagagtgtgtggaccgtgtaatccactgaaccattttccgattccctgtgcacacgcgtctctacgtcacccgtgaagctcaccgtgccattggattgaaccagatctccttgtgcacacccgccgccgacgcaggacacccgcttgcgcacgtggaccgagcgattctggccatccccgcc

SEQ ID NO: 7757 - DNA, 158 bp, Zea mays
tacctaagactatagacctattttgttcactgcctaacttgccacactttatttaacttttctaattaatgttagttcttcaattcgaacgcctaaccttaggcaaagtgtggcgcagtttagtcacgaaccaaacaggccctatatgatacacatgc

SEQ ID NO: 7758 - DNA, 71 bp, Zea mays
tgctataactaggtgagtgcccgtgcgttgtaacggaacatataataccacgataacttatatataaaatg

SEQ ID NO: 7759 - DNA, 74 bp, Zea mays
atggttgatggtctgacttggcctcccaccctgccaccgggttggacggtcgagtgggatgctgctccgacagg

SEQ ID NO: 7760 - DNA, 86 bp, Zea mays
gccgagtgcccatgatctggcactcggcaaagatttttttttattttaaaataagctttgccgagtgccagatcggggacactcgg

SEQ ID NO: 7761 - DNA, 182 bp, Zea mays
aattagacgcagccggctgcaaaccagaatgtttgcagtccctcacaaaaaagaggatatgccccacctgcaggtgcagcaacacaattaaaacgatatctgatagacttacaggtaggctctattctccttttttaagaggggctgcaaatattctgttttgcagccagctgcacccattt

SEQ ID NO: 7762 - DNA, 113 bp, Zea mays
tcgacgacttgttcgagcttttgtcgagcactttgtcaagctttgtcttcacccgattcttgggatttcttgatgacgcacggaacgacgacgagatcgagtcaggagcgagc

SEQ ID NO: 7763 - DNA, 213 bp, Zea mays
cgccatcctctgatcagccgccgcccgctccgccattatcctcgcatccatctcttgacgttccctcctctcttcttctagttgggtctgtaatattacaagccaacgttatactaactcaaagagaaggtatataactcaagaaaggacgagttacataagcactaacctcgagttgctgtatgcgatgctgtgagctgtcgtgccgaggtc

SEQ ID NO: 7764 - DNA, 79 bp, Zea mays
cccgaaaaaagtactagacaaagaaggctttgccactgtactgtttgtcgagccctctttgccgagtgcgacactcagc

SEQ ID NO: 7765 - DNA, 145 bp, Zea mays
cttgctctctaagggctgatttggtgatcggggatcccgaggggaaaaaattctcttgctattcaaaattaaattgtaaggtgattcctccgccatggatcccccttgggatcactaatcaccaaatcagttcctaaggggtact

SEQ ID NO: 7766 - DNA, 93 bp, Zea mays
ggcaaagggttctttgccgaatactttttttcggacactcggcaaagactttgctgagtatcaaaaagcactcggcaaagaaaagccctcggc

SEQ ID NO: 7767 - DNA, 76 bp, Zea mays
caaggacttcagccgacctcttcatcgttcaggcaactaccaaatcgagttgtgatgtggtgagctgattcgctat

SEQ ID NO: 7768 - DNA, 105 bp, Zea mays
taccctagagtgtgcagctctctggacacgtagtggtaccggacctgcccaggtggtgaggttggtgctattgctggcccagagtagtcgcacgacgcttgggcg

SEQ ID NO: 7769 - DNA, 109 bp, Zea mays
agagtgcgggccagaataaaatagtttttgcgaattacaagggcaaacagccctgatgagtcaaacaaaaaatttgcggaggttgtcgatgttccaggagtgctccagg

SEQ ID NO: 7770 - DNA, 194 bp, Zea mays
ggcagggcggcggcggcggttgctggcacgggcgaggggcgagcgttaagggtccggcggctgttcgcgccgaggggggtgagtaggcagggcgatggtggctgcaggggttgctcgctcgcacggatgggaggggctgacgaccaggggatgcacgcgggcgtgggcagcatccgacggacgacgaaaagaga

SEQ ID NO: 7771 - DNA, 137 bp, Zea mays
ctggcccgcgaggctggaggctagcaggacgctatagagatgtctctctagtatgcagcactagagatgctgctgtctctgttgtcctctaaaggaggatagtcaaaaggctcctgctgtcctctagatgctaaagg

SEQ ID NO: 7772 - DNA, 248 bp, Zea mays
tttttataacgttggatagtgcaaatttagactagaaaacatcaaaccaaaaaaaaatggagggactttctctctatcttgctactcgcgtctgtcggagttggccctcctttctccgcatccggcaataggggaaaatcacgatatgacttcccttagaccaactccagcaacactctctatcccactccgcatccgcattatacacgctctgagtcactatttcgctctccagcagcctccgcatc

SEQ ID NO: 7773 - DNA, 87 bp, Zea mays
agtagtatatgttcccgttgcaacgcacgggcactcacctagttattatgtaagtgcctgtgcgttgtaacgggaacatattataac

SEQ ID NO: 7774 - DNA, 129 bp, Zea mays
gtactgtcgaaggccatgagggactccctgtgtctgagatgtgctctcattattactctgcgtatccgccctttgaagtggcagaggaggatgcagacgaaaggggcccttcgtgcgccgcggtcagaa

SEQ ID NO: 7775 - DNA, 106 bp, Zea mays
gcctagatgggtcggcgtgccactgccgcggcccaggcacctttcttctctttttaatctgttagtcgtgccgggccggcccggtggcactatggcccttataatg

SEQ ID NO: 7776 - DNA, 216 bp, Zea mays
tgcaagcagacgttaggtgcaagcgtgtaagcagctcaattggtgcattgaatctagatctaaccgtatgtgtaatcgtgatttgttagggttttttataaagttaaacgagatggtggtggaaggatttaaacgttaaatatagcaatacggttagatctaaatctaacggaccaaaagacatgtttgcacacttgtatataatggctgcttgca

SEQ ID NO: 7777 - DNA, 84 bp, Zea mays
accggaatttggctctttgccgagtgtcatattcttttctgtgtgttttatttcgggcactcggcaaagagctcttttgccgga

SEQ ID NO: 7778 - DNA, 226 bp, Zea mays
aagaaggatctgttgtgttgtgtttatgtgtaaactcacccgatgtggccgtgctgttcgcggcggagcggtcgcagcgggcgttgcgggcgtgcggagcggtcgcggcacacatgcgggcgcttcgcggcggggttcgcggcgggcgtgcggaacggtcgcggcggggttagcggctggcaggcgggggtagggaggcgggggcagtctacaataagctcttaat

SEQ ID NO: 7779 - DNA, 197 bp, Zea mays
ggaccccatacggtggttgcggtggcggcggctccccgactcgaacacacggtggtggcagttcctcgattcagagcgacggcagcggttcccagatcggcgacgcagtggcggcgactccccgatctaaagggcgaacgatggcgggaccccggtgcgggcaagaggcggtgaccccggggccccgaggcgagcaa

SEQ ID NO: 7780 - DNA, 87 bp, Zea mays
actcggacacgctgatcaggctgcgttggtaatcagctgagttatggcattagctgaatattggctgcgccctgacaacacgacaca

SEQ ID NO: 7781 - DNA, 139 bp, Zea mays
aaatctctcagggctgatttagtgaccggtgatcccgaggggaagaaatcctcttgctattcaaaattgaattgcaaggggattcctccccatggatccccttggaatccctaatcaccaaatcagtcctcatgtgcct

SEQ ID NO: 7782 - DNA, 126 bp, Zea mays
ggcatgtttggtttgatgactaagttgtcacactttgtctaacttttctgtctaaggttagttcttcaattcggacgactaaccttagtcaaagtgtgacacagttagccacgaatcaaacatgcc

SEQ ID NO: 7783 - DNA, 257 bp, Zea mays
gccagggggaggaggtgcgctgcgcaggggctagggctgcacgccgggacggctgggaccaaggcgcgaccataccctgagaaacgaaggaaaacagagaacaaaaatggagacgctcaccggggaagaagaccctcgtcggagtcgaggagaaatatatcgattgacggagattcgggggtccaatcgatgaacaggacccatcgaggcgaagcccttgatgagacgaacgcagcggtaccctcgaattccgttga

SEQ ID NO: 7784 - DNA, 80 bp, Zea mays
gagatcttttgaagttggctcgtccacgtcggggacggctgacggaactgtacgtggggacccatactttatttcttgcg

SEQ ID NO: 7785 - DNA, 202 bp, Zea mays
ctgtgtcagactttggcctatatgtgtttctagttgattgcttcctagccgatgtgtgatctcacaaagacaccacgtttctgtgtcaggagactctgcttttaacgcatcacttatttgcataatgaaattgtattgtgtgatgaataggcttgtaggttcggagtagtataggtgtacatttgggtcgggcctgacgggt

SEQ ID NO: 7786 - DNA, 99 bp, Zea mays
aggcccaccaccgcgacctggttggcgatcttgtgctgctctagccggtgcccgacgcatccatgcggatcgccctgccaaggttagcgaagaacggag

SEQ ID NO: 7787 - DNA, 69 bp, Zea mays
accggtggtggcgtgttgtggcccatgaccccggatgtcggtgttttgggtccgaccgcacacccgggg

SEQ ID NO: 7788 - DNA, 116 bp, Zea mays
gctagttttagagccacaaaaccggaggaaattggaggggctaaaatcccctttttatttaagaaaaaggattttagcccttacaatcccctccggtttttggctctcaaactagt

SEQ ID NO: 7789 - DNA, 122 bp, Zea mays
gggactagtttgagagccaaaaaccggaggggattgtaagggctaaaatcctttttcttaaataaaaaggggattttagcccctccaatttcctccggttttgtggctctaaaactagctct

SEQ ID NO: 7790 - DNA, 112 bp, Zea mays
tagttttagagccacaaaaccggaggaaattggaggggctaaaatcccctttttatttaagaaaaaggattttagcccttacaatcccctccggtttttggctctcaaacta

SEQ ID NO: 7791 - DNA, 138 bp, Zea mays
catattgggccggcccgttgggcggcacgaggcccggcacggattggcacggcccaaacccggcccggcacgacaatatccgtgcccgtgccagcccggcacgacccccgtgccgtgcttgggccgataggtcggccc

SEQ ID NO: 7792 - DNA, 74 bp, Zea mays
aaaccacctagggcatgttcggttacactaatccagagggggattggtgtaaccgaacaagcccctatgcggtc

SEQ ID NO: 7793 - DNA, 157 bp, Zea mays
caaggaaagactagggcatgtttggttccctgcctaacttgccacactttgcctaacttttctgtctaaggttagttcttcaatttgaacgattaaccttagccaaagtgtggcgtagttagtcacgaaccaaacaggccctaggtacgtctgaata

SEQ ID NO: 7794 - DNA, 110 bp, Zea mays
ttataaaaacttgacttgcggggctaagacaacctccgagcattgtgtgatagagaagacctctcatacatgccaaaataaccttgtccgcgtgagcgaccgcgacctcg

SEQ ID NO: 7795 - DNA, 169 bp, Zea mays
ttagtgtttagttcgctactgtgtatttgtatatcttgtgctacttttgtgcatttttcattatatttatacatatgcatcttgtatcttatttaggaccgagagatgatgatcgtgcacgtgatgtggtgccaaccacaagatgcagttggtggacaacccaaggaag

SEQ ID NO: 7796 - DNA, 72 bp, Zea mays
aaggccactacactcggcaaagaacctataccggtgcccaggtcttggttctttgccgagtgctatggtcct

SEQ ID NO: 7797 - DNA, 203 bp, Zea mays
tgcaacttgggtcgtgccatgccggcccagcacgagcccgctgtgcttcgggcctcagttagtcaggtctggctagcacgaaatagaatcgggtcgtgccttaccgggcctggtgagtagaagtaaggcccagcacgaccctaaagcacgacgggcttccatcgggccttgctggcccaggcacggcacgcaataagtgaaca

SEQ ID NO: 7798 - DNA, 196 bp, Zea mays
cacttattgcgtgccgtgcctgggccagcaaggcccgatggaagcccgtcgtgctttagggtcgtgctgggccttacttctactcaccaggcccggtaaggcacgacccgattctatttcgtgctagccagacctgactaactgaggcccgaagcacagcgggctcgtgctgggccggcatggcacgacccaagtt

SEQ ID NO: 7799 - DNA, 97 bp, Zea mays
cctctaaaccagcactcggcaaagaaagtacctttacctagtgcctagcctagctctcgacaaatgtactgcactttgtctagtgttgacactcggc

SEQ ID NO: 7800 - DNA, 255 bp, Zea mays
ctatcgtgatggcgtcgtcgtcggatgctgggctacgtataacacgggagtcgccgatgttggcgacgaccatgaggtccccctgcttgacgatggacaacgtggttctctcgctctggaccacgtccaagtggcggctgcgtcggagcttgtcgtacacagcggcgcatgccgccacgtaggactgcttttagaggtcaaactgacagtcatcaagcttcttctcatcatcgatgagcgacgccaacgcgattg

SEQ ID NO: 7801 - DNA, 137 bp, Zea mays
catgaagtatagagtgactccacaaaccaaacacaccattagtgaaacatgacactttttagacctacaatttcatatattttaggtaagaggtaatatagggggtgtttggtttgagtgatcactccatccaaaat

SEQ ID NO: 7802 - DNA, 84 bp, Zea mays
gtgttacttgtcgtgctcgggctgggctgggctccttcatgggtcgtgctttccgggccagcccggcacggatgagcttgttta

SEQ ID NO: 7803 - DNA, 242 bp, Zea mays
caacactcggcaaagcctcggatttcggtagtggctactccgtttaaggattggctacctgttgttcctcgggagcgaattgatgaagagatagtttcatcagtggttattagggatcttctttcgatgtctatggctgtgtcaaagaaccagaggcgacccaacaaaatagaatcgagagcatacttgtaattacgatcccgaggaaatacttgtatgaagctatgatgggatttaaatga

SEQ ID NO: 7804 - DNA, 98 bp, Zea mays
gagtgccagccgttggctctcggcaaagaggttctgtaccgagtgccacatagtaggcactcggcaaagcatactttgccgagtgtcatctctggaca

SEQ ID NO: 7805 - DNA, 71 bp, Zea mays
tttgctcggcgccatagactatggcgctgaggtaacacatctcggcatcataagctatggcgccgaggtac

SEQ ID NO: 7806 - DNA, 119 bp, Zea mays
cttaaagcaccagtttcaacggtcgtctcgcgtcattttttacatataacccctcacagtttgtcagcgtttcggacttgcgaggaccgtcaaccgaccagtgaatttgttgctgcgtg

SEQ ID NO: 7807 - DNA, 92 bp, Zea mays
ctcgggccgacgggagttatgggtccgccacgtcagcccatgcaggcctagggaccaggacgggggagcgacaactgccgtcggcttggcta

SEQ ID NO: 7808 - DNA, 221 bp, Zea mays
gtctccgcctgagcggggagcgtagggcaaagcctggacacgtgccagcgccggaccctcactcatgttggggtcctttccgtcccgggaccttgctgtgggccctgaccttactcgaagaggcctagggctcgtcggtatgccttcttgggagttccggaccacatccgagggttcgggctgtgcgtacaggggtccggtgttcctctgtggaggttcgg

SEQ ID NO: 7809 - DNA, 185 bp, Zea mays
actagttaggtgcccgtgcgttgcaacaacacacgaccaatacgacaaaatgttaggacacaacgattacataaaaatgaatacaaatattatggtcgataatatatgtgttcatttttatgtaatcgttgtacactaacattttatagaataatttgtcgttgcaacgcacgggaactatacta

SEQ ID NO: 7810 - DNA, 94 bp, Zea mays
gagcgctcgtacggctgtctgcgctatgcggttcggacgcgctttacagtatctgtgggacccgcggcatgacacacgcagccgagcaagtgtt

SEQ ID NO: 7811 - DNA, 126 bp, Zea mays
ggctggttaggagccacaaaaccggagcagatagaagaggctaaaatcccttttttattcaattttaataaggagtggaatttagcctctacaataccctctggtttttggacttccaaactagcc

SEQ ID NO: 7812 - DNA, 86 bp, Zea mays
aaaaaccatagcaaagtacgggcaactaactagtttagatttatgagtttactaggtaggtgcccgtgcgttgccacggtttctat

SEQ ID NO: 7813 - DNA, 134 bp, Zea mays
atgctaggggagtgtgacactcggcaaagaaagcacgacgaacgtaaagtgcggcgcacacgtcttctttttccgagtactttttatcaggcactcgacaaagactttgccgagtgttaacagttacttggcaa

SEQ ID NO: 7814 - DNA, 162 bp, Zea mays
tgttcactctgtagcaacgcacgggcattcacctagtgtacatatatatttgctagtaaaatatattaaccaaaacacatagtatacaatgtacaaaagggagaatttgatgagcatgtctttttctacccatatcaatgatcctgccttgtgaatgaggaa

SEQ ID NO: 7815 - DNA, 123 bp, Zea mays
cagcaaagaggtgctttgccgagtgtcagggccatagcactcggtagagaaggaacacctgggcaccggtaaagcttctttgctgagtgttgtggccctggcacttggcaaagaagcaagctt

SEQ ID NO: 7816 - DNA, 78 bp, Zea mays
tagggctagggttttcttagtgggctgggccgggctggaatgggctggcccaagacactaaatcgggccgcgctaatt

SEQ ID NO: 7817 - DNA, 95 bp, Zea mays
tttgtatgccgtcgcaacgcacgggcacctacctagtacccttgatgcttaattgattactaggtgggtgtccgtgcattgtaacgggaacatat

SEQ ID NO: 7818 - DNA, 221 bp, Zea mays
ggcggctaccgtgccacggacggtccagatcgattaacggcagaacgacagaacgagggaggcagactagctttgctgtcttaataagtagtaagattcctatgacgtgtggacgccttcttttctctcttctcacattttctcgcgcacgttcacagcttgtaggagttccagtgtcgctgctcgtcttccatccgcaccgcccgcggcaaccgcacgac

SEQ ID NO: 7819 - DNA, 123 bp, Zea mays
cgctaaacacgactgagtgcagggcgaccttgtattggtcccctttccgccttctatatggatcggagaccagatgaccgcaagaaataaagcatgggtccccgcgaacagtttcgtcagctg

SEQ ID NO: 7820 - DNA, 78 bp, Zea mays
gaggcccgatgctgccacgtggactatcgcccgtgacgtaagccagcgggcggagtctgacgtaaggcctctgggccg

SEQ ID NO: 7821 - DNA, 102 bp, Zea mays
ctattgttgacgtggcgtcgacgtggcctcgtagctaggatcgcatacaggacatatgtaggtacgcgaaatctggccattttggcagcccgatgtgtgcag

SEQ ID NO: 7822 - DNA, 73 bp, Zea mays
tggaggagatggttgctgggataacttggtcgtgcaccttgccaccgggttggactgtcgagtgggaccctgc

SEQ ID NO: 7823 - DNA, 132 bp, Zea mays
aagatatatagggggtgtttggtttctaaactaaaaccttatttagtttccatatttaaaatttaggaattaaaatagaataaaatgaagggactaaaaattgtctagaaaccaaacaccctataatatagt

SEQ ID NO: 7824 - DNA, 82 bp, Zea mays
tttgatcgcttgcgtgaccggccgagcgcggactcgccgcagcagcgcgcgccccgcgcgtggtcgccccgccccgcgcgtc

SEQ ID NO: 7825 - DNA, 109 bp, Zea mays
ttctggggtttaggcgaagtcgtgcgtgcatgaggggcccgtttctgcgaggttggccagatggtcctctttgtttttgctggtgacgcacgatgtcgtccccttacgt

SEQ ID NO: 7826 - DNA, 156 bp, Zea mays
accactgtcagtagcggttgcgtgcgcaggcccaaaaccttgaacctgggcagcaaccgaggttcagtaacacgcagacaaaacttacacactcccccgcacctatttagctacttagccacctgcgagggcccggccgcggccgtggggtcttcg

SEQ ID NO: 7827 - DNA, 228 bp, Zea mays
ggcacttgcacatgggtaagccgatcctaggggatgggggaaacccggtagatagcgggatcacgcgcgtcacccgaaagggaatcgggttaagatttcccgagccgggacgtggcggcagacggcgacgttaggaagtccggagacgccggcgggggcctcgggaagagttatcttttctgcttaacggcccgccaaccctggaatcggttcagccggaggtagggt

SEQ ID NO: 7828 - DNA, 132 bp, Zea mays
cccccacttcttctcatttctccccgagatccctcccccctttgagacagtaaccgcggcagtaaacagggcggcgcggcttaccagcggcgagggaggtccggcgaagggtggggttagctctgggaagtc

SEQ ID NO: 7829 - DNA, 75 bp, Zea mays
ggtgagtgacgcacccaacaacctgcttcagtcgacacgtcagattgaaccaggttgcaggggtggtcggcctga

SEQ ID NO: 7830 - DNA, 111 bp, Zea mays
cgaaacgggcctggttgtgggttgggccaggcaaccaaacacatccatagtggtccatgtggaccatagaccattctacgtttggctaagtccatactccatatccgtatc

SEQ ID NO: 7831 - DNA, 247 bp, Zea mays
atggggactctagagtcgacctgcaggcatgcaagcttgtccgccttgggcccatcgtgaatcctattgtaacaccctaaaaaataaaccattttacatacaacaggaatatggtgtgtctctatggatgatcggaggccgtagatgtatagatctcatcaagatgattccgatcaatcactagtttgccttgtttgaagtccagatgagtcttttcgagtgtcggttgatctgagccattggatat

SEQ ID NO: 7832 - DNA, 105 bp, Zea mays
tgccccagagtgtgcagctctctggacacgtggcggtaccggacctgcccaggtggtgaggtcggtgctgttgctggcccagagtagtcgcccgatgcttgggcg

SEQ ID NO: 7833 - DNA, 148 bp, Zea mays
tcgggccggcccaagtatggtccagtcactcgtgtcgggccggccggcatgatgggctgaaaatcaaagcccagcctagccctatactcatgccgtactggcacggcacaatatatttcgtgtcggaccgtgctttgagccagttttc

SEQ ID NO: 7834 - DNA, 83 bp, Zea mays
cgaggatgactgcttcatattctgctatatcatttgtgcatctgtcagattccagagcgaagctgaggcgagccgcatatctg

SEQ ID NO: 7835 - DNA, 70 bp, Zea mays
gatcactgaaggctggctctagagatgcgaccaatctgctcgtatctggtgagcctggctcatggtgctt

SEQ ID NO: 7836 - DNA, 131 bp, Zea mays
ctgcgcaccggtttgtcagcgaagtcctgcgcagattcagtgttcaaatacatcagcttacgccgaacgccatagtggcgctggcgaagtatgtctgggcgacgacttcgtacggcgggcagccgtcggtg

SEQ ID NO: 7837 - DNA, 143 bp, Zea mays
ggaggcggtggtctcctcgggtgtgcgagcagcagcgatctcgggggccagcggcgttggtgccctgatgaggagggcaactgacgacaacgctcccctagaatcgagcgacggtgacgctcccgaagcggaccagcggcggc

SEQ ID NO: 7838 - DNA, 143 bp, Zea mays
aagccactttaagggctgatttggtgactggggatccctaggggaagaaatcctcttgctattcaaaattgaattgcaaggggattcctcccccatggatcccctagggatccctaatcaccaaatcagtcctaaaagggaga

SEQ ID NO: 7839 - DNA, 149 bp, Zea mays
tagcttcggctctgcgccatccttcctattctttgtgcgtcctcacgctgttgttggaacttgctctctgtcgcaaggggatccaacgggaggtgtggtgacgtaaacagggttctcgcacaagatggcaatagctctgttaatctagc

SEQ ID NO: 7840 - DNA, 166 bp, Zea mays
gccgtgttaggctggccgtgggcttgacttgagacctagacacggtccgtatatagggctgtgtcgacccataactacaattaaattgaaccatatcaaatttagactgtgtctaaaattatgcgctttggaccggagtgtgagccacaccacagtacataacatg

SEQ ID NO: 7841 - DNA, 159 bp, Zea mays
tgctatggtcctggcactcgacaaagaagctctatttgttgagtgtcagctagagcactcgactgcgggcgaggcacagaagatacctttaccgggtgccagacaggcagtcacttgacaaagggaccttctttgccgagtgccagcttacgacaatag

SEQ ID NO: 7842 - DNA, 158 bp, Zea mays
cataccaacaaggtgcattttttctttcgcaagcctatctcgaaagaacatccaagttaagcatctttggcttagagcaatttgggatgggtgaccgaccgggaagttttcttgagtgagcatgagtgaggacaaagtgcgcactaaagactcgtatt

SEQ ID NO: 7843 - DNA, 205 bp, Zea mays
gcttgaccgagttgcgccgcccgcccgtcacgacagcgaccacactggcgccagccgaaacgacccttccagtgtccactacttgacccgaaacggtcctatccctaggagtgacataggcaaacacatatgatattttcttacctcagattatggcgtctggagtcctacccatggtacggcgtggcacaacgaccctccctca

SEQ ID NO: 7844 - DNA, 244 bp, Zea mays
acggtgaagggcgcactggcgggtaggtgggcacgtgaggttgggtgcatgctggtttaaggggcggggtggcaagcgaggcttgtccacgtgaagcttcaccctaggtgacaaatagcgcaaccctacacacgtgcgcgcgtgtatatatatatatatatagtatatgtatttagagccctaggctctatttaactataggaagccccgaccacgtaccgaccaggtgcgcgaccgcaccgga

SEQ ID NO: 7845 - DNA, 120 bp, Zea mays
ccaggtttccttctttgccgagtgccatggtcagcactcggcaaagatggctttaccggttcccaggtttccttctttgccgagtcccatggtcatagcactcggcaaagcgaccctttg

SEQ ID NO: 7846 - DNA, 104 bp, Zea mays
ggctcatgactcttatgtctaagtatccatgtctctcgggacattcatggtctcttataaatctggagatgtctaggctctagggttcttgagacctatgggtc

SEQ ID NO: 7847 - DNA, 84 bp, Zea mays
aaccacgcctcgctgggttgctcgacgggtaggttggtcggcgggcttgccctgcctcgctgggttgctcggtggatatgttgg

SEQ ID NO: 7848 - DNA, 68 bp, Zea mays
agagaggataatcgagccagtgatgttgtgccaaccacaagatgcagttggtggatgacctgaagaat

SEQ ID NO: 7849 - DNA, 106 bp, Zea mays
ccctccatatccaacggtgctgcgtcaggggggtttttgtaatatgcacaaagtttctaagaacagttggggccccccgtgtcctgacatcgttcgccatggaggg

SEQ ID NO: 7850 - DNA, 197 bp, Zea mays
gaaaagtcagatcctgcatttggttagagggtatgaccatcagtttggcatgtagattgttaatatgtagtataattaattaatcaacaaaattaatccaaatacaacagctttcatagctcaattggttagagcacccgtttagtaagcgggaggtcttgagttcgactctcaacgaaagcagtttttaggcgcaa

SEQ ID NO: 7851 - DNA, 133 bp, Zea mays
actcggcaaagatgctctttgccgagtgtcaaggccataacactcggcaaagaaccaagacctgggcaccggcataggttctttgccgagtgtaatgtctctgacactcggcaaagaagcacgcttgtcgagt

SEQ ID NO: 7852 - DNA, 107 bp, Zea mays
cccgctggtggcccctttgccgagtgtaggctggtggacactcggcaaagaggtaaactctttgccgagtgtattaggtgacactcggcaaaggcgccgtctccgtt

SEQ ID NO: 7853 - DNA, 71 bp, Zea mays
aagacctcctgcttgcagcgattgagcctagcgctggcggcctccctcagtcgctcgagtcacgagaacat

SEQ ID NO: 7854 - DNA, 76 bp, Zea mays
gcgggtggcgcacccgacagcctggttgagtcggcgcactggattgaaccaggttgcagggatggttgatctggtc

SEQ ID NO: 7855 - DNA, 124 bp, Zea mays
gactcgcccctggcggcggtcttggtcaatgcgtcggcctcctcattcttggcctatccacatgctgcaaggtgaatcccttgaattgcctctcgagacttcggatggccgcgaggtattgcat

SEQ ID NO: 7856 - DNA, 97 bp, Zea mays
tgccgagtgccggcggctttgccgagtgctttttatcgggcactcggcaaaatagactttgccgagtaccgcactcggcaacgttctgcactcggta

SEQ ID NO: 7857 - DNA, 111 bp, Zea mays
tgtttttttgggcactcggcaaagaagctctttgtcgagtgccaagcaaaaaaccctcgataaaagaaaacactcgacaaagaagctctttgccgagtgtcaaaaataaaa

SEQ ID NO: 7858 - DNA, 83 bp, Zea mays
cggcaaccccgcctcgctgggttgctcaacgggcagggtcggtagtcttgcctcgctgggttgctcagcgggcaggttgctag

SEQ ID NO: 7859 - DNA, 239 bp, Zea mays
gtccaaaaattttttgtaccttcttggctcgagcctatttggtccgatgcacgatggactcggttatttcttaaaattgggaagaatataatggatatggtgagattacattttcaggcaaactatatatatatagtatttagagccctgagctctctctaactattggaagacccgacccgcaaaccactcggtgcgcggaccgcaccgtaccgaccaggtgcgcagactttttggct

SEQ ID NO: 7860 - DNA, 128 bp, Zea mays
acaggtggtgatgccgagtgctctcagcttgcgaaggcccaggatggcggcttcttactctgctatgttgttggtgcacctatcggactctagagtgaagctgaggcgtgctgcgtatcggtgcttga

SEQ ID NO: 7861 - DNA, 95 bp, Zea mays
gttctcgcctgagcggggagcgtagggcaaggcctggacacgtgtcggcactggacccttgcctgtgccgtatttctctctgtcctgggacccta

SEQ ID NO: 7862 - DNA, 92 bp, Zea mays
aaacttttgcagagtctaacagaatagatgactagcttctacatctaagctattaaaacttcacccgttttgctgcgctctccgcattcggt

SEQ ID NO: 7863 - DNA, 107 bp, Zea mays
gtaacggagacggcggctttgccgagtgtccctggtacactcggcagagaagctgtctttgtcgagtgtcttccaggcagcactaggcaaagcctcggattccggta

SEQ ID NO: 7864 - DNA, 78 bp, Zea mays
cgagtgtgacactcggcaaagaagtctcgggtaaagactgcatcggcaaaaagcttctttgccgagtgctttatctcg

SEQ ID NO: 7865 - DNA, 127 bp, Zea mays
gctcgttaccgagagccgagctttgccgagtgcggctctcggcaaagccgtctttgccgagtgcccgagaaaaggcactcggcaaagcggccggcactcggcaaaggctcggattccggtagtggtc

SEQ ID NO: 7866 - DNA, 105 bp, Zea mays
gagctggctcgagctcgtgtcgagctggctcgttaccgacccgagctgagatgttagctcagctcggagtaaaagaggcgagccgagccgagctgacctcgagtc

SEQ ID NO: 7867 - DNA, 106 bp, Zea mays
aggaatattcggaccaaggtccgatctaccacaccacgtgagcacgccgccgccgcccgggtgaggtcgtggctcgtgatagatcggaccttgatcaattattaca

SEQ ID NO: 7868 - DNA, 202 bp, Zea mays
gcgatttagctccggtgaagtggtcgacgacgttggggaggtcacagcggtcacgtcggtgtgcgggtcggtgtcggagatggccgaagttggtcagtcctcgcgcgtaggagggggagctcgtcgacggcgagtgattcggcctaaccacgacggtatatctcaggccaatgagttggggagcttcacggaaagtcaggga

SEQ ID NO: 7869 - DNA, 162 bp, Zea mays
gggttgtctcggggacgggtttggggagctaaaacccgacggggaattccccgttgccatccctaggggtgctcgtagtaggggttacaagcgtagcacgcgcgcgcgcgagagggagagagagagagaaagggttccgccttgagttgtctgagttagcct

SEQ ID NO: 7870 - DNA, 74 bp, Zea mays
gtttatgagcgtttgttatgtggatttatgcactaagatgtgtgtcaaaacaggtggtggacttccagatcgta

SEQ ID NO: 7871 - DNA, 68 bp, Zea mays
agagagctgccaggagtaagtaccgcctgtccagggattggacggggtgttacacttggcgactttca

SEQ ID NO: 7872 - DNA, 95 bp, Zea mays
agaggctggccaacggtggcttccctaggaaggagcagtaaggcaagggtaaaaccaacgtcttatcccgggtggagccacacgtactcgtgggg

SEQ ID NO: 7873 - DNA, 228 bp, Zea mays
tcctggcttggggttgaccgacgaggacgtcagtgttctaagggggtggattgtgatatcctagaccagtggattgcgcgatatcctgcctaatgcttaataagattgatagaatactcataccaacaaggtgagttgtgcccagagcaactccaccatgagggcaatgaggtgggtatgaggaaccatagcagagactgaagcctcatcgttgactcagaaaaccaa

SEQ ID NO: 7874 - DNA, 104 bp, Zea mays
ggcctcatgtcgcgtctgctcgcttgtcctgcgtatagctagctggccctggccatgtccatgtacacagacagacgacgacgacgacgcgtcgtacgtgcagc

SEQ ID NO: 7875 - DNA, 247 bp, Zea mays
caaatgagccgcctctaggaagttagctgcccacgctagcttcctacgacctcctctaggaagttagctttcagttgctgatccgtgggtgcagtcaaacgaaccgctaacttcctacgacctactctaggaagtaagattctcctgctaacttcctacagcgtcctctatttatgttagctttcagttgctgattcgcgggtgcggtcaaacgagccgctaacttcctacggccgcctctaggaag

SEQ ID NO: 7876 - DNA, 114 bp, Zea mays
caacgccggcgactctcgggttgttctgggcaccgcatccgacgacggcgccgtcacgccatctagctcatcatccacctgaagctcaaccggccacgtaagtcgctactgacc

SEQ ID NO: 7877 - DNA, 195 bp, Zea mays
atgcatcaaactctaaggatgcgtttgtgtttggtggcgggacagcaggataagaagtcccctggcgtcctctctcttgtttaaggaatcatctcttaatccctgactctaaaacaaacaaccttatttaaggaatcgtcctatcctatctcgttatgtcattacaaccaaacgcaccctaagagaacatgcaca

SEQ ID NO: 7878 - DNA, 111 bp, Zea mays
cgcgttgtgcaggcaggcaggcaggcatgtcatcagcgcctggcttggcttctccactccacccagccagcgtcatctgataaggcttggccggctggcctcgctcgaggc

SEQ ID NO: 7879 - DNA, 214 bp, Zea mays
aaggacctgtccaagaggaggaccaggatcaggcttcagaggctgctattgaggatctccccgcagcctcagcaatagaaggcaagccccggtatgcacaccacgcatatatgctactactacacaatgcggaggactagtaatgcgcacttagtgtagagttgcttgaaacctctagttgcatgaacttaggactcctttttgagtttgtata

SEQ ID NO: 7880 - DNA, 99 bp, Zea mays
atattcttattggactttgtgtgcggtgtggcccctgggagatgggggcccaggtcggccgcccctcccgccctacctcaggcacggccctgagtccta

SEQ ID NO: 7881 - DNA, 146 bp, Zea mays
atagattaagggcctgtttggtttgtggctaaatgtgccacactttgcctaaggttagtcgttcgaattgaataactaaccttaggcagaaaagttaggcaaagtgtggcaactgaggtagtgaaccaaacgggccctaagatcat

SEQ ID NO: 7882 - DNA, 112 bp, Zea mays
tgattactaggtgagtgcccatgcgttgcaacatggacatataatatcatggtaacttatgtattataatatatgtctccgttgcaacgcacgggcactcatctagtatatt

SEQ ID NO: 7883 - DNA, 242 bp, Zea mays
gggtaaggagtatctctttgtaactggttacaccgatgctagcttcaaactgacctagacgagttaaaatcgcaatcaggttttgtgttcacaataaatggtggtgctgttagttggaaaagttccaagcaggagactgtgactgttggactgtgaacccctaaccctaacagggttgggtgatatattaataggctgagtaaactgggccaggcccattacagaggggtgagatggacatt

SEQ ID NO: 7884 - DNA, 102 bp, Zea mays
cgtgggaccagtggggccaacagggcgaatcggctgacaacccgatggatgatatctcgagagaaaaatacagcgacacgcacacgttgctcaagaaaaagc

SEQ ID NO: 7885 - DNA, 72 bp, Zea mays
taccggcaaagagcgcgcctttgccaagtgcctgttggactggcactcggcaaagaaggctcaagtgggtcc

SEQ ID NO: 7886 - DNA, 124 bp, Zea mays
caaatatgccctctttgccgagtgtctgctggactagctcttggcaatgggagcaccagtgagcccctttgtcagtctctttgtcgagtgcaataggagacacttggcaaacagtgcttcttta

SEQ ID NO: 7887 - DNA, 229 bp, Zea mays
cctctccctcgctctgcgcgcaagaccagagaactccgccaccacccgccgtcgactgtcgtccgttctgcgaccgtcgtcgagcccacaccctgtctgttgcctcagtgagttccaccttgccgtcagctactcgggacaccctctggtttgctcttcctctctttggtttgcccggtccgcgctcatcggagcgtttcttgcgcagccggagctccgccgccgtcga

SEQ ID NO: 7888 - DNA, 70 bp, Zea mays
aagacctcctgcttgcagcgattgagcctggcgctgccagcctccctcactcgctcaagtcacaagaaca

SEQ ID NO: 7889 - DNA, 199 bp, Zea mays
ataggactaagggggtgtttggtttctaggaactaatgtttagtcccttcattttgttccattttagtatataaattgacaaatatagaaactaaaatagagttttagtttctatatttgataattttgtaactaaagtggaataaaatgtagggactaaaaattagtccctagaaaccaaacacccccttagtcctat

SEQ ID NO: 7890 - DNA, 79 bp, Zea mays
gtcggtagctaagacgctttgccgagagccaattttttccaagtactgggcactcggcaaagaagtttttgctgagaac

SEQ ID NO: 7891 - DNA, 165 bp, Zea mays
cctgagtgaaccccttcggactttatccctcatgcaacctgagacagggtctcccatgctagctatggtgggtacaagtgcggccactgcacgacggcagtcggggtcattggagcattgtatgccaaggcggtgaggcctggacgcgaacggggaatcgatggg

SEQ ID NO: 7892 - DNA, 92 bp, Zea mays
ttacaatcacaggcggttttgtcttagggttcgcttgtgaaaatgatagagcaccacaggcggtcctaaacaaaaaccgcttgtgatactat

SEQ ID NO: 7893 - DNA, 150 bp, Zea mays
tattaaaatattctttgccgagtgccagatcagcggctctcggcaaagagttctttgccgagtgtcccccgttccggcactcggcaaaggttctttacttcctctttgccgagtgtcacacatctagcactcggcaaagaagtctttgcc

SEQ ID NO: 7894 - DNA, 84 bp, Zea mays
cgagtctagggctggaaggcactcgcattctctcgctcttttcagacttacgcctggtgcgggtgcctctcagtttggagctgc

SEQ ID NO: 7895 - DNA, 70 bp, Zea mays
acatcattggatcattggcgggtggctgagtctgacaagagactgactttccttggtggtctgtgagaag

SEQ ID NO: 7896 - DNA, 118 bp, Zea mays
aggcacgggacatgaaagggccgcgtcaggctctgacactatactaaccggaccggatcgtgcctggactgtgctttttcgtgtctttgcctgggccggcccatcgtgttagtgccaa

SEQ ID NO: 7897 - DNA, 68 bp, Zea mays
ccaccggggacactcggcaaagaacctgacatggggaccctctctggcggggtatttgccgagtgtcc

SEQ ID NO: 7898 - DNA, 210 bp, Zea mays
aggccctgtttggcacagcttattttcagcttcttcacaatttaagctgaagtcctgccaaacaggcagcttctgcagcagcttatcagttcagttgcttctcaaaatgaacaaaaagcagccaacaagcagaagctgctttttaccagcttatcagataagttgctttttcaacaaacagcagctgtcccaaacagggcctaaaaagac

SEQ ID NO: 7899 - DNA, 74 bp, Zea mays
ggcagatcgcgggcactcggcaaagatttttttaatgtaaaaatagtcgttgccgagtgtagagcggagggact

SEQ ID NO: 7900 - DNA, 165 bp, Zea mays
tgtctaacgtcgagcactcggcaaagatcgtaaatatatactttgccgagtgcctgctctcctcatgccctcgacacagcgttgtttgccgagtccctccgctctacactcggcaacgactatttttacattaaaaaaatctttgccgagtgcccgcgatctgcc

SEQ ID NO: 7901 - DNA, 190 bp, Zea mays
cacacaacgtttccgtcgtcaaggcccagactcggttcctctcaaaatgaaatatataaatctatatctatactactactaatagggtgcccgtgcgttgcaacggaaccgaattataacacgataacttacatgtctctgttgtatgttatagatatgtgtccgtgcgttgcgacggaagtaaaagatt

SEQ ID NO: 7902 - DNA, 184 bp, Zea mays
tcggcaaagtaagttttttgccgagtgcctacctctggaactcggcaaagttaatttgtaaataaaaaaagaactttgtcgagtgccccagatctggggcactcggcaaagtatatttttaaattaaaaaaatctttgccgagtgccagatcacgggcactcggcaaagagcttgaccttaatc

SEQ ID NO: 7903 - DNA, 144 bp, Zea mays
catactaagggcatgtttggtttgatgcctaacttgtcacactttgcctaacttttatgcctaaggttagttcttcaattcgaacgactaaccttaggcaaagtgtggcacatttagccacgaaccaaacaactcctaatagtt

SEQ ID NO: 7904 - DNA, 76 bp, Zea mays
gtcagataactatcttcatcgagtatttttaggctttgtcgagtgcttcagacactcggtaaagaagttgtgtctg

SEQ ID NO: 7905 - DNA, 210 bp, Zea mays
acccacaaatcatagacacagacggtcccaccagtcatagcaaatttctcttcatgaggtgcatgttgtactgtatccatgcgttctgtatgtgtgttctgcggtgtaggcgtgtagcttatttgttgtcatgagaataaagttccttctatcaatttgatagatgccagttgcatccaggttggctcgtctgtgcggtgctaagaagat

SEQ ID NO: 7906 - DNA, 249 bp, Zea mays
gtaagtcgctactgaccgaccatgaattcttggcgcaggaacgatgaccattgtgtgtgcgtgagtgttttcgaacaagatgtatgcccaggagtagcacatccggtggtgcaacgaccaggtgtactacctcgctgatgagctcggggtgcattttttttggcagcccagccaagagtggtcggtactcaccatatcgctgcgttcgacgactatttatatcaaggattgtggcgtcatctcgacacc

SEQ ID NO: 7907 - DNA, 78 bp, Zea mays
aacccccgatctggctgtgactgcgcgctcctattgttcaggctgacgtggtgctgcgcgggctcagcggctacaaca

SEQ ID NO: 7908 - DNA, 138 bp, Zea mays
aaagaagcttctttgccgagtgccaaaactcagctcttggcaaaggtaacagccgtcagttttagacagtggctgacggccctttgccgagcatcaccgttcgctgagtgtttggctctcgacaaagatgtctttgcc

SEQ ID NO: 7909 - DNA, 116 bp, Zea mays
tgaatcctaaccctaacaggggttgggtggtgtattaatagacttgagtactgggccaagcccagttacttaaggctattaatatagcacccaacccttgctagggttttccaata

SEQ ID NO: 7910 - DNA, 78 bp, Zea mays
tgctccggtccccaggcgaagtcttttgcaccgcggagtgttttgaggaaggggagacttcgctcggcgaacctggag

SEQ ID NO: 7911 - DNA, 118 bp, Zea mays
tcggcaaagttgtctttgccgagtgccgttctgtgccgagtgttcagcgctcggcaaagcacgttttgccgagtgcctaacgttaccgagtacggcactcggcaaagctttctttgcc

SEQ ID NO: 7912 - DNA, 155 bp, Zea mays
tggcggctggcctggtgcctggtgcgtggtgccctggtggccgcgttagggtcttagggttagcaaatagcgagagcaaattcattttatatgagacatacgtgtcatatattagcgggtaccccatcgggtagcgggtatggggcaacagagaa

SEQ ID NO: 7913 - DNA, 127 bp, Zea mays
gcaggtggttgcagaggagcagcggagaagccggccggccgtgcgagcaagccgtaggatacggctgggcgttgaacgccgccgccaccaggcgctcggcctcatccctatccgctgaaaccatcct

SEQ ID NO: 7914 - DNA, 82 bp, Zea mays
ctcatggtggtccctccggccggggtggcggccacgcgtggccgtccttctacaacccctggaccgggaccatcgccatgtg

SEQ ID NO: 7915 - DNA, 205 bp, Zea mays
  unsure (7): n = A, C, G or T
cggaggntgacggacctttgccgagagccgcccttcaccgagtgtttggcaaccggcaaagaaatctttgccgagtgtattcctgtgccgagagtcctactctcggcaaacggcgtcgttaccgagtgcccgacaaaaagcaatcggcaaagctccgagcactgggcaaagctccgagcactcggcaaagacccggattacggta

SEQ ID NO: 7916 - DNA, 119 bp, Zea mays
gatatcatgctatgggtctgtttagttcggcttttttctgaatagcttttctgaaaagctggctgtggagaaaagctattcagaaaaggccgaaccaaacaggccctaggtatgacttg

SEQ ID NO: 7917 - DNA, 74 bp, Zea mays
gaggagggaagccaacgaggccgtcgccaaggagcaggctgcgcaggcggaggccaagctggcgcgggcggagg

SEQ ID NO: 7918 - DNA, 88 bp, Zea mays
ttaatccatgtggattgagtgagattgggtgggtttaaaatcaaagcaagtcaaacttcccaacaccctccaatatcatctaatccat

SEQ ID NO: 7919 - DNA, 169 bp, Zea mays
atgcgttgaccaggctgttgcgcgtgtttgtttgcatgtatgcagatggccagacctgcatgtacaggtgcagtcacgtcttcgcgggaggtttttgtcctgcatgtgtcgatacacgtgaaacctccgtatctgtgggagcaggctcgcgtgaggccggttacacaca

SEQ ID NO: 7920 - DNA, 222 bp, Zea mays
cttggtaaagaggtctttgccgagtgccagatatttgacactcggcaagaagtctctttgccgagtgccggccctggcaagggtgacgaccgtcagctttagacgtcgctgacgtcccttgccgagcgccacctttgccgagtgttgccactcagcaatctgtcttgtcgagtgtgttctgtgccgagtgtcttgcactcggtaaacgagctcatatcgaga

SEQ ID NO: 7921 - DNA, 152 bp, Zea mays
ctcatcagcgattgtcatccgcgccatctccacacgcccagacgggtagtgaaaaaaatgcctagcctgcacacccgcatgctggccaggcctttttttttcactacccgcctgcatgtgtggagatggcgctaatgacgatcgctaaggag

SEQ ID NO: 7922 - DNA, 112 bp, Zea mays
atgagaatagccggggtgggccggtgttgaggcccgggcggggtgaaacgaatgctgttttgtcgtgggccgggattttttccagaccgggctgatccacggggaattgggc

SEQ ID NO: 7923 - DNA, 98 bp, Zea mays
gcctgcgcgcgtggaccgggcgattccggccatctccgacgtcaagccgtacctcgacgtgaccgccagagtctccccgagccaccccaccctttcgc

SEQ ID NO: 7924 - DNA, 151 bp, Zea mays
tgctggaatgtggtagctcgtttagctcacgagctgggtcgttaacgaaccgagctaggatgtcagctcagctcatgaaaaaaattcaaacgagccgatccgagccgagccgagctgaccatgaaccgagcgagccacgagcatttcgtcc

SEQ ID NO: 7925 - DNA, 92 bp, Zea mays
catattttttcttcgcgggtatgggtttgggcaagtaatacccagcgggtttttacccgttgccatctctatatctcgcgtgaagctcgcgg

SEQ ID NO: 7926 - DNA, 168 bp, Zea mays
caagttaagcgtgcttgccttggagcaatttgggatgggtgaccgaccggggagttttctcgggtgcacatcagtgatgacaaaatgcgcacaaaagacttttgttggtgtgtggggacgatatatgatcctagagagctgtcaggagtaagtaccaccggtccagag

SEQ ID NO: 7927 - DNA, 140 bp, Zea mays
cccctgtttttgcctctccctttggcggggtgcccccaatctcccctattcccagagggccggggagaggggctaggggattgggcccccaacaggtacccggttgtccgccttgcctcgggcagagccaaagatgaaag

SEQ ID NO: 7928 - DNA, 95 bp, Zea mays
gtgaggcacgccgcctgccagctgagtggacaggcaaaataaatgctgaggcggcacatcacctgtcagcagggtggacaggcggcacgtcctct

SEQ ID NO: 7929 - DNA, 74 bp, Zea mays
agtcatggaagacgacgacgacgacgcgcgctccgaatcggctcgctcgtcgtccgtcggcgtcagggccatgc

SEQ ID NO: 7930 - DNA, 128 bp, Zea mays
acgtggcacatacctcgacgccatagatcttggtgccgccggtcaacgacccttacctcggcgccaagatctatggcgccgaccttacctcggcgtcaagatctatggcgccgaggtatctgcatata

SEQ ID NO: 7931 - DNA, 86 bp, Zea mays
ggcgcgcagcgacagcggcagcacgggggagcgggaccggcggttcgaccagttcaaaaccttcggcgggcgcctggagcggcagc

SEQ ID NO: 7932 - DNA, 202 bp, Zea mays
tatgaccttcgtccgaagctcattaaatccttggggagataatgcttcagcggatgaagggcatttatgcttaacatttttgtgttgccttgttcttaattcgaagcatttgtgaacaagtccccaacaatagcttttgggaatcaaatgatatgactgtttcttctggatggttctgtagcgctggactgactcggacata

SEQ ID NO: 7933 - DNA, 91 bp, Zea mays
agctcgacgtcaagatctgtggcgccgagctagattgccacgtgccctgccacgtcggtaagctcggtgtcaagatccgtgacgtggagct

SEQ ID NO: 7934 - DNA, 193 bp, Zea mays
acgtggcaatctagctcggcgccacagatcttgacgtcgagcttaccgacatggcagcgcacgtggcaacctagctccgcgtcacagatattgacgccgagctagatcctgacgtcgagcttaccgacgtggtagcacacgtggcaacctagctccgcgtcacagatcttgacgccgagctagatcttgacac

SEQ ID NO: 7935 - DNA, 252 bp, Zea mays
acgccatactaggagtaccgaacccactttagtaagctatttctgcaaaagtatcaaagttgactcttgctaaagcctctccttgattcccaattccagcatacccttgagagtcttttctttagtcaggtaagtcttgctgagtaattccatactcagggttttattccctgttgtttttcaggttatagttttgtgctgctgttgatggtgttaagtgtcggtgggctcggccttcttatataagtatac

SEQ ID NO: 7936 - DNA, 156 bp, Zea mays
gtatttcggattcgggtttcaggttacgggtttttttgtccagccctaaatggggcaaccagtgggttgtctatgggtgcaatatgaagtgcctgtacacagtacttctgttctaactaggtcagtgcccgtgcgttgcaacagaatcatataata

SEQ ID NO: 7937 - DNA, 212 bp, Zea mays
tgggtagccaccagactccatattacacactctattcgcatgcacgtgttagactgacagttagatcccatgagcataggctttaattgcaccatttctcatacttgtgccatttctcatacttgtgtggagagaagacatgagaaagagagtggagatgccccgacgtgcattatggggagagggatgcggagtctgggagagtgtgaaca

SEQ ID NO: 7938 - DNA, 121 bp, Zea mays
acactcggtaaaggcttcctttgccgagtgtcaactggttgacactcggcaaagaatctagaacatatatttgccgagtgtctatcacttgacactcggcaaagaagtctttactggagtg

SEQ ID NO: 7939 - DNA, 148 bp, Zea mays
tgagtaccaactggcactcggcaaagtctttgtcgagtgcccgataaaaagtactcggcaaagaagctgttgccgatgtactgttcgccgagctctcttttctgagtgtcacactgggcaaagtgtttgccgagtgcctgaagcactc

SEQ ID NO: 7940 - DNA, 77 bp, Zea mays
tactggaagacgatgaagatggtggcgacgagatgcgcttgcgtttctgcgcaccttccttcgtcggcgccgtggat

SEQ ID NO: 7941 - DNA, 125 bp, Zea mays
aaaaaaaagaaggtctttgccgagtgctgaatcaggcgatattcgacaaagaatttctaaaaaaataaaaaatatctttgccgactatcgaatcaggggcactcggcaaacattttaaaaaaata

SEQ ID NO: 7942 - DNA, 101 bp, Zea mays
agtgtactaggtgacactcgacaaagagaatccatttgccaagtgtattaggtgacagcttgtgttaggcttttcctctttgtcgagtgtccgctgggccc

SEQ ID NO: 7943 - DNA, 222 bp, Zea mays
ttgccggacccttaagtgtgcgttttgttgtgggacaattaggacaggaacgacccctgacgttctctctcgtccctccaattttgagggataactggagacaacactgggatagtactgtcacaacccctgacactgaaccagacaacctcatttgagggatcgtcccgtctcatcctatcttgtcattgcaaccaaacgcaccctaaagaactcgttggt

SEQ ID NO: 7944 - DNA, 72 bp, Zea mays
accatgtctaatggaccagcacgaggcacggcttatttaataatgacgtgagtcgtgcttgagtcgtcgtct

SEQ ID NO: 7945 - DNA, 107 bp, Zea mays
gtttccgcctgagcggggagcgtagggcatggcctggacacgtgtcggcaccggacccttgcttgtgccgggatcctctccgtcctgggacccttctaaggcccgaa

SEQ ID NO: 7946 - DNA, 185 bp, Zea mays
ccgcaccatctcatcttggatcatcgcattcgttaactttatttgagattaggtttggttgcttgtatgtaatagtcacaacctacatatgtggatataaaataagtcattttgatactattaacctacatacactcatacactcaaaattatcgtatctggctggccaggatgacgccaggctg

SEQ ID NO: 7947 - DNA, 88 bp, Zea mays
aggggcctaacagcggggtgctggttggcgatgttgtgcacttgctgtgattgcggccgtctcgaccggagtctgctgcggagtcctc

SEQ ID NO: 7948 - DNA, 82 bp, Zea mays
ttcgtgtccttcggattggttcctaggctagaatgagtggaccactgttttctggtctagaactgtttccgacgtgaaatac

SEQ ID NO: 7949 - DNA, 200 bp, Zea mays
tgtgttgtgcctaataggccggcccaaatcacacaatttctggcacggcccatatctggcacagcccaatctaattgtgggcctgggccggcacgacccacattgtgggccgtgcctgggcctcaattaggttgagacgtgccagacttggaccgtgccagaaattatgtgttttgggacagcctattaggcacacacaa

SEQ ID NO: 7950 - DNA, 158 bp, Zea mays
tcccaaaacacataatttctggcacggtccaagtctggcacgtctcaacctaattgaggcccaggcacggcccacaatgtgggtcgtgccggcccaggcccacaattagattgggctgtgccagatatgggccgtgccagaaattgtgtgatttgggc

SEQ ID NO: 7951 - DNA, 76 bp, Zea mays
acggcgtgatggcgtcgtcgtcggatgcttttgtccaacaacccgagagtcgtcgacgttggcgacaacacatgag

SEQ ID NO: 7952 - DNA, 224 bp, Zea mays
aagatgcgccgaacaagctggccatcgtgaaggaggacgcacacaacgatcccgtcggaattgggcggagccagccaagaagtggcgccgacagtcatggcaatgacaggatggggagtggtggggggcacgccgagggaggtgctactgtatacagcagcagcaaggtcgggaggagcggtggtggcagtcgaggacagcgaggagagcattgaggagaggcc

SEQ ID NO: 7953 - DNA, 118 bp, Zea mays
ggtaaagaagctctttgccgagtgccacacaaaaaaccttcggtaaaagaaaacactcggtgaagaagctctttgccgagtgttttatgtttgacactcggcaaagaggttctttgcc

SEQ ID NO: 7954 - DNA, 184 bp, Zea mays
agggaggcgcgcgtacaggagggtcgatggcgtgctcttatggggaggcttgctcggggtgttattgcacctgggtttatatatatatatatatatatatatatatactacttattaaggttgtaagagtagtctgccattccgtgttctgccaccattctcattccttgttctgcgtttctca

SEQ ID NO: 7955 - DNA, 131 bp, Zea mays
cttgaacaaatcactcatgtaaggcgccttttataacgatagtattggaaaccctaaccctaacaggagttgggtgatctattaatacagtaactgggccaggcccattacagagggtgagagggtattct

SEQ ID NO: 7956 - DNA, 108 bp, Zea mays
tcggggttcaggcgaagtcgtgcgtccagcataaagagaaacgtttcggtgaggtcagccaggtggtcttccttgcttctgctggcgacgacgatgtcgtccccctat

SEQ ID NO: 7957 - DNA, 55692 bp, Zea mays
  misc_feature (7779)..(7780): n is a, c, g, or t
  misc_feature (9820)..(9820): n is a, c, g, or t
  misc_feature (15860)..(15860): n is a, c, g, or t
tagggctagtttgggagtccagcggcttgctgcggctgcaataaggccttgttcgtttgtattgcgtgcaaggagccaagcatggtgtcaaaaacaggtggtggagacgacgacgacgatgacccatgggctcggccttcttatatacggccggccggccggccgtcaagatcagaaagagaccagaggggcagtctccttggctagcccagaacagagcggctccgttccatcggatgcaccagatcgctttgtgccagaagcggcgatgggattcaaacccatccaatcccagagccagctcgttagctcgaagtccgacacggccactgacagacgactaaccttaggcaaaataggttgacgagattggccagggagagctaaccgaacaagcccggcaaagtgtggcaagttaacagggctaatttggtgattaggcggcacaaacgaacaaagtctcaccgactgcaacccagctcttaagtgccggtgggctcggcccacaaacgaacaagacctcagcgccgcgccgggccgccgccagggcctgtttggtttgtggctggcaaagtgtggcaacttaggcgtcgtcggcgcggacgagagtaggccctgtttggaagcaaccactcggcaaagagccaaaacctttgccgagtgccagcgacacagagctcccttcaatccaaatacacttgtgacgtcaacatatgcacgtgccctgcttctccaaacaacatgatgtagttcaatcctattccctgtcattgagtactgatttggtgaccagggatcctggaccctatgctcgggactggtgcaagcatgcaatcaaataggagcccgacgtctgcatcttcgtcgtcaaccgccgccgccgattgagagctaaccgaacaagggcctgtttggtttgatggtgggcttcttcttgcgcaggcccagtggcggacgcaggacgaaggctcgggctctcagcgacggcgaccgcctcctccggcacggcggtgaggtcgttggcgctgtaggcagaaccaggggaggaagcacgcggcagtgcccacccccctctttgccgagtgccagcgaacacaaacgaacaaggcctaacttgcacgcttgcacataatgtgtcatggcttgtggctgaatgttgcaacgcacggacatatagttcgtttccgtcggattacagttcgtttccgtcggattggagggggtgtttggtttctagtggagcagccaggctcccaaaaagttggcgagcgaagcggagacaggagcagatgcagacgagggccacaaaccaaacaggccctttgctcggcggcggcgtagcgcgtggcaagttaggcatcaaattccagtcggttggcggcgatgggtgcaagcatgcaatcaagcgccgactgccgtggagagcgcgtagcaacgcacgggcacatgcaccagcggcgacgggaacctcagatcatgctggcagcttcatagtccctagaaaccaaacactagctgatagttgcgtgagttactggaccgcctgtgatgtgtaaagacactcggcaaagaaacaaaacactcggcaaagagctcctttgccgagtgttttttctctcggttacccgtgcgttgcgattctcggccttttggctaagacggctgacaaccgacgggaattggatcagatggtttgcttgtcttgcaggtagaagccatcctagtgactgctgtattgctgtccactcgacagtccaacccggtgggggtgtttggtttctagggagtccctagaaaccaaacaccctggccgccgaaaatgactgtcctccggttttgtggcttccacagacgagcagcgagcggtttcgattccaggtgcaatccgacttagccacgaaccaaacagcccaggctgtttgcagccccacacgctggagcctggaggatcgtaacccagggcttccattacctgggtcacatcaagcgtttaacggctcattccggtacaaccgacactatgtgtacaaacctaaagatattggcacggctcaatcattattataaccaaacacatccgttaggcaaagtgtggcaagtgtcaaacgcttgatgtgacccagatctagatcggatgcaccaggtcccgatctgcaccaagcgcactatgtgtacaaacctaagagtttctctctaaggtatgccaatgacagaacgggatgagattttttctacagtattttgtctagtggattaagatgtattgagtatctctatatcgtcggatctcatgctggcagcttcactcattagatcatgctggcagcttcaaatattagaggcagcgcatacctggcagctctgcttctgtcgttaccgagtctgttagattagcagttcaagaaagcctgtggattagatgaccatcagcaaacatggcttaaaagtgtggcgcggagaatgttattgttaagcttcggattggatcgaagggagctccatgctggcagcttcaccaacggttcacaaaatgtaacgtaagtggatttgtgtggccgtcattagttaagccgtgtgataaatgatcaatgcgatccctttggaccggcaagtcatccttggctgagagttgatgcagatctgatcttagatcatgatccaaccgtactctcatatggaaccaggctaatcttatgactggcaacggctatgcagcatcatcaagattctgttttttgacctatggattaggctaaaacgccttaacaacctcagttcaagaaagctgtggaatggcatacaaggaatgagtatgttggatgtggagggtgtgatacggtcctctaaatttagatgacggtcctctaaatttagagatcggataaaaccacgcctaccattgcacgtttgcaccaaaatagggctgcttggatggccactataccccaaattcagggtgttggtagcttcgttaagctggcggtgatggttaggtcgcagcccgagttcaggaaccaagtgacactgccgccacgtcccggctcgttatgcttcgttgtgtacgaagagcatggcatcataagcattcaggcttcgttgtctttattcacagcctatggcgccgagctatagtccctagaaaccaaacataaacgcttgatgtgacccggggtgacccgggctaaactttaggtggactaaagtttagcccggcacgagtcgagcgagctcacggctagatagcggaccaacagaagttagccacgaaccaaacagtcacaaaaatgaggatagactatcggctatccatatccgtcaccgagctcggcgccatagatcccatagatcttggcgccgagctcgaggacgagctgcttatcctagggctagtttgggagctcagaagcactcggcaaagctagaaagggtgcgtttggttgcaatcgactgctgcggtgcgccaggtggatcagatggtttgcttgcgagcttagcttggcccatgcgtgcgtttggttgcaatgacagagctgccgactcatccattcaatcagaaagaggccagaggccgcccgtctagctcagtcggtatgctgtttctctgcaggacaagtgcggcggctcccagatccgggcactatcaagcaggcacgggggctcgagtccagccatacgattgcaaccatcagtatcatgctttgccgagtgttttttgtcaaacgaacaaggcctaaggctcacaaacgaacaagaccttaattggcacggctcaatcagagattagctggaacgattccgtgtgaaagtcaaacgcttgatgtgaaaactttgttcccaaacagtaaggccttgttcgtttgggtcacggcgaaccagcaagcgaacaagcggaccctaagacaaaaacaaacgcttgatgtgacccggaaggccttgttcgtttgtgccataactaaccttaggcagaaacggccaaccaaccaatcacgtttggcacagacctcattgctaccagggcgccgccgtcggcgagcgtctgaacggatggcttcggtgggccgtgcttttgtgggctaggatgtgtttggttgcgggccatagcactcggcaaaagaaataactaaccttaggcaaaaagagactttgccgagtgtgcccgacacaaacgaacaaggcatcaaaacactcggcaaagaagctgcttctttgccgagtgttttcaaaagcactcggcaaagaagcgtagagatggcaatggggaccagttagccacgaaccaaacatgaaacgaacaaggcctaaacgaggccttgttcgtttctgccggacgtgaacgagactccggatatgtccccgttgcaacgcatgctgatttggtgacccgggattagcccggcagcaaaccaggatgtggcaagttagacagtgaacccccccccccccccccccaattagggctagtttgggagtcatcgtgcgttgctacggagtcaatggtgcaagcgtgcaaccaaatagtccctagaaaccaaacaagacacaaacgaacaaggcctaaggccttgttcgtttgtgtcgcagactttcaacgtgtgttgacccgccttgcaccaagtgaatcgatctgcaccaagcgagcccggcaaagtgtggcaagttagacaagatctatggcgccgagcttgaggccttgttcgtttgtgcagcctttgccgagtgtcaggcggcgctgatgaccgtcgctgaaagggtgcgtttggttgtaataaactttggttgagaccaatctagggctagtttgggagcaaaacagcctaaggttaggcatgcgtttggtttgtggctaattatagccaaggatgagctgcctgtaggcagtctccttggctagtccttgtgacttgcgacgatgcgcctactttttcatctcccgcaagccacgaaccaaacaagcccgctgatttggtgaccagagaagaagctcctttcagctgatgctaggatgtgtttggttgcctgggattgaccctacctgcaggtgtgatgagggtacggctccagacaagtaaggccgcaacggtagagtccaaataccggagaggaaggtgagtgaccgtgcgtcatcacgccaaagcacaggtctaactgatttggtgacccgggatctcgtctaacctcaatctcattggcaaagtgtggcaagttaggccagactagtcggttgtccgtgagaagacgacggagtcgctctcgcgagctaaacgagccgaggtgccacagacgcggtctaggactctaaatttagaggatgaggaagcctggtccgagatcttgtagggctagtttgggagttaggagatgctagggctatccacgaatttcggatacggatacggggaatggacggctgagatcgcaaggccttgttcgtttgtgccgacttgctagaggccaactggagctgtttggactgctgctagagtgacaagttaggcagggaacaggccttgttcgtttctgtcgtgcgtttggttgcaatgatagacggctatcgggtcccattgaaagtcaaacgcttgatgtgacgctgtttttttttcttttagatcgcgttctttgccgagtgtcctcagttgccacagtttgccatcactctcttctgtcagccactaagcttatgtccgacggtggtaagcttatgtccgactgcttgctgatttggtgaccagggatataggctatgacgccgagttaaagacaaagggcctgtttggtcttgcaggtagaagccatctttagggctagtttgggaggtccgtgcgagattcgctggcgtggctcagcagaggaggcagcacgcacgcacgcagggtcaccggcaaggccttgttcgtttgtgtttaggctatctccagcaatctaccagactgtttgcagcctctcgtgagaggctgcaaacagtctgaggggctgcaaacagcctgcaatcgtcgactagggcgactatagggctagtttgggagcaagaggaccgaccaggcgcctaatcactcggcaaagaacactcggatgacgaccgttgaaactggtggcaaagtgtggcaagttaagagttagccacgaaccaaacaaccgacgcaaacgaacaaagcccccgtgcgttgcaacgggaatactgttggactgcgggtttccgagtccaaataccggaggggactgtgagtgcgacgacgacgggtgagccgtcgcaacgcacagcgttgcgacggctcacaacaagcttctttgccgagtgtttttaggcagtctccttggctagcctgaggccttgttcgtttatgtactccactttgccgagtgcaagcttctttgccgagtgtcaggtaggcgagtcgtgactgcgtcctgggccagacccattacagaccaaacaatgtagtggacggtgttaggaacgtgggtacccactagtccctagaaaccaaatacgtttggtttgtggctaattacatgtgcccgtgcgttgcgacgaggccttgttcgtttgtaccgtagggctagtttgggagcacaccttttctcggcgtcatagtccactcggcaaagaaggcacactagggctagtttgggagccatagcaatccggttaggaatcgtgcctctgctaagccgtcagacactagcaggctgacgggctatgagacactggatatagggttgaaaggcactcggcaaaggctccacaaacgaacaagaccttaggtttggtttgtggctaactgtcactcgacaaagaaggcacacgagagccacaaaaccggagggtaagtgccggtgggctcagccaggccttgttcgtttgcgtcgcccaaatagggccttagatcaaaggccttgttcgtttgtgtcgacacaaacgaacaaggccttcgtgggtacccacgttcttacaaccgaacaaggcctaaggtggcgtgctggagcaacggcgattgtgccagaccggcccatatgagagctgatttggtgattgggcccaagaatcaggtgaagacgagccacgaaccaaacaacccgaaaccaggccgtttgcagcccaccttaggcaaagtgtgacaccccgtgcgttgcaacggggactttctcacggtccatctgtgaagttagccacgaaccaaataggtttggtttgtggctaactattcgacgacactgtcaacggcgagggcttgttcggttgcgagagacacaaacgaacaaggtcttaaggccttgttcgtttgtgcttgctcgtgcgttgcaacggaatagtccctagaaaccaaacccagagctgatttggtgatcagatagggctagtttgggagcctcagggtaggatacaggatgacaaaaacactcggcaaagagcttatcggatgcaccagatcgtttcaaccatatcggtcggctttggacgacaaccagcgagccctatagtccctagaaaccaagcaccgaccgaccgaccgacctgctaaccgaccggtttgaccgccgcaacttgaccatgggagccagcggcttgctgcggctgcaatcagaacagagcggctccgttctcggcacaaacgaacaaagcctcggcaagttgttcttggctacccaattcgtcgaagccggactaccgtttggtcatctatatttttgttcggttagctctcaactcaagcccgaaaaggcccatatggcctattagctcagttggttgacccggactaaactttagcagcttctttgccgagtgttgtgagttgctttggcagtgtgcgggcttctttgccgagtgtctaattctttgccgagtgccaaggccaagcgctcgacaaattgtctagttagccacgaaccaaacgtaaaaagcactcgacaaagcgcatcttagtctctaaattgctacgtgcgagcaagccgtaggatcagacactcggcaaagtttataagagccggattccggtagtgatcccacgggcctggctgaggacatgattaaggtcttgcggagaagggcacagctgagcaaaagaataagggctaaaccgacggcggtttagcccttattcccgttgcgctaagcacgtttgattctgggaatcagacctgatctgcaactttggtgacaggaacaaagccgcctaggtctccgacgtgcgccgcggcgccgcctcggcgcgtgggtacccacgttcttaatcgacctctgctgagcgcgctaggatgaagccgctctgttcccagtgttgtccccagttgtccgatgcattttgcgcatggaaggatgcattttgcgcatggagcagagcatctccaacaatgccttagtccctagaaaccaaacangacacaaacgaacaagggctagtgtacgactcgtctggcaagttggcacggctcaatcagaaatagtccctagaaaccaaacagagatcatgttgcagcttcactgacccggactaaactttagtcgtgctttttagtgtcgtgcccaggacttccgagtagcacctcgaaacgaacaaggcctaagctaggccttgttcgtttctatcgagggcttgttcggttgcannnagactgtgtccaacaagcaccgtgagttgtgactgcgtgtccggatcggaccaaaacacgcggcgtgggtacccacgttctttagagggtgacttggccagccatgtggcaagagaattgaagaaacatcaaaactgagggcaccaatcgtgcttcgtgccaaatggaagggctggacaaaatgctcgtgccataggctatggcgccgagcatagcctatggcgccgagcacccgtgcgttgcgacggttcatagggctagtttgggagacacccgagctcggcgccatagattcatagcctatggcgccgaggttgcttatgggaagggagacaggtcttagggtccgcttgtgaatgtgccagaccggcccacatagcacgacgaccgttgaaactgaaacgaacaaggcctaaagagaagaactaaccttaggcagaacgcattggacttgcacgtgtgacagcctatggcgccgagtatcccccccccccccccccaattcccgtgcgttgcaacgggaacgaagtggagtggagcgggcgctggcagaaccggaatggtggctagtccctagaaaccaatcacacggcccagcccgcgattcgtctgtgccaaacagggcctaagggtgacagagcctttgtcgagcacaaacgaacaagacctaaagcagcaagactgacttcgcggtagggctagtttgggagctaccctgagccaggctcaccagatggactaagtattggctcggcggcgagaggtcccgagttcaatttggcacggctcaatcaattagatgagctagcgcctgcgattgtttggtttgtggctaaatgtgggcctgtttggtttgtagctcagtgttgtccccagttatccatgtgttaaggtggattaggagaaaccgaacagggccttagtcactcggcaaagaacacttgatggcgcctgagaatccatagtaagggtgcgtttggttgcgggagagcaggctcggatgagcgagacacgctagatctggggggagcacgtgattcacagggacatgatcgaaaaggccgtccctttaacaaaactgggacagaacggttagctggaacgattccgggtttctttgccgagtgccataaccgggcggcgggttcgcgtcggtggcactcggcaaagaaccaataaaaagaaatggagggagtagccatagcctatgacgccgagggcccgtttggccatctataccgtttgcgtcgcgctctatatgaaaccgaacagggcctaaagttagctggaacgattcctggtcccgtgcgttgcaacggaaacaaaaagcactcgacaaaaaaagggcctgtttggtttgtgtctctaaacactatgctgtgggtccactgtgcgccatcatcaaatcccgttcttgctacctgctaaatgtgcccgtgcgttgccacgggacttggaggtgctactcgaaaggctgtaaggggtaggctgcacagagtggtggagcgtgcagtcagtagcgacttacgtggcgaaaccgaacagggccttaggcggcaagttgtccttggctacttgtgcgtccattggtgaccgacagcctatggcgccgagcaatcaccagcgacgaggagcaccgtttggtttgtggctaatatggccacactttgtctaagtttactaaacactgtgctgtgggtcactggcaggtgatgtgccgccaagcggaccctaagacaaaactctgcattgccgaggctggtgtcccgtcagcagtagaggcgttggatcagatggtttgctgaccacatttctctacggtgcacggagagccacaaaaccggaaggcagggatgagacagagcatggacagccgtcggacataagttaccttgtgcaggcaaccaaacaaacatgatgccgcgggaaacacttgggccgggccggcccggcaggccttgttcgtttgtgttaaaaacactcggcaaagaatctacggcggcgccggcggcgtcagttggctagagggtggaaggctgcgtttggttgcaatgacatggctgcaggagctgtgccagaagagcatctccaacaatgtgctagtccctagaaaccaaacgacagacactcggcaaagtatatatgatgtgtttggttcggtgtcccgtgcgttgcgacggaaccgtgagtgtccgtgcgttgcaacatagcctatggcgccgagatgccataggctatggcgccgnnccgcgggggtcgcctgaggtnagaacgtgaccagttaaacgggtcaaagtaggatgagtcgggtcaccagcgctgcactcaatttacactatagtgcctaatcgtagttttgtctcgcgggtatggcgtgctttgaccgggtgggaacactcggcaaagagccaaattgatcaggttgcgttggtaatcaatccacatggattgagatgaagagctgcaagcctgcaaaagaaaacactcggcaaagaatttaaggcctgtaggacttcgctctaggatgtgtttggttgcaattaggcagattgtggcgctttagaactgcgcagatcgacgacggctaacttcctagaggctacaggtgacctggcgcgcacggtatagggctagtttgggagttcaggtgctagcacggcacaatctgtggcaaacagtttgtcggcttaggcagattgtggcgccttagtatcgcacgagacaggctagctttgccgagtgtttttttttgttttggaccctttgctcggccacgagtcgagcgagcttacaccgggtgcaatccgacgtaaacctatggcgccgagcaaagggttttacatcacaggcggttcgccgtgcgttgcgacggtacacaagcctttgccgagtgtcgcatcgaggacgagctgcttgtctgccacactttgcctaagtttacgtgggtacccacgttcctaagacacaaacgaacaaggtctaggtagcgggtgcgtgtacgagtcgcgagctaaacgagctaccgctgtgggcgtgcaaatttaggacacaaacgaacaaggcttagactggcgggacacgtgtccagaaaaaatctcttgcacctaacactcggcaaagccccctttaagcggctcgtttgaccgtctgaggcaaagtgtgataagttaggaaaccgaacagggccttataatgtgcccgtgcgttgcttagaagtctgcttgcacgcttgcattagctggaacgattccggtgactagccaggatttggtgggcgccaagatctatggcgccgacccatagatcttggcgccgaccctgtgccaaacagggccattaaaacgaacaaggcctaaggttgcaggacgaccattgaaactgccagactgtttgcagcccctccaagtgctcggtcgaagacttaactgacaggccgcagtgatgatcaggggcggacctacgttaacagttagcaggccggcatgatagtccctagaaaccaaacgccccgtgcgttgcaacggcaaataggatgtgtttggttgtaatagaacggagcgtcaacgtccaagagcatctccaacaatatctatcccactcacgtgtcacgtcaccgtacttgtgccagcacgtgaggcgtaggcgagggattaggctgatttggtgaccaggaatgtgtgcacgcctacactacgtttaacgagccagctcgcgagccccgtgcgttgcaacggaaataaagactttgccgagtgtcaatcgcgagctaaacgagccaacggcaaagtgtggcaagttagtgtgccaaccagactgcctcgcgatggacggccaagtcactccagagctaaccgaacaagccgtaagatctatggcgccgagctcgccaagatctatggcgccgagctgcgtgcagatgtggagccagacacaaacgaacaaggtttatgaggccttgttcgtttacgtgtatccgacccgataggacccctgacgcagcaccattggatgaccattggatgtggagggtatctgtgccaaacagggcctaaaataactaaccttaggtagaaagtgtgactgatggtgggtcgcaagcccggcacggctattgaagctaacttcctagaggcagccaggtttccggcgtgcgcaggtgatgcattttgcgcatgggaaataggctatgacgccgagctcaagagggtgtttggttgctgccgaacgacgacaaccggtgaggaattcttgtgcgctgggacgatgggcctgtttggtttgtgtgcaaagcctttgccgagtgttttagctggaacgattccggttgctgatttggtgaccagggaaagcagctgtgccaaacaaggcaggccttgttcgtttgtatcgccgcgggggtcgcctgaggtaatcgtcgtcgtcggccacggcccgcgcttggggtcgacttggtcattctaacagactctccaagacacaaacgaacaaggactaaaggccttgttcgtttgtgactagactatgtgtgtgggtcggcagcaaaactgagggcacacgaaataaaaagaaacggagggaaattagaccatatttaatacttccaaatggtttaggattagggaggctgaagctgagtcgcgattgacagaagagagcgagcacaggaggaggccgggaagcggcgtgtctatgatttgtgggtcctccgacccaccaatccagcagaaataaaaagaaacggaggggaaattagttttataatttgacggcagtctccttggctagtccgacggctgagatcgcagaatggtcgcggggatagggcggacggccataggctgtggcgctgagcacagcctatggcgccgagctcctgtttggttcgtggctaacttagccacgaaccaaacaggtcacaaaaatgaggatagactcgaggaatggacccatgatgcaggcgtcgtcgtcggatgcggtagctcggcgccaagatctgtgtcctgcctcgatgccggcggctgcccgtgcgttgcaacggtatcgtgatccattaccacccctcacaaaaatgaggataggtccgttggaccgttgcagagtggagccggattggtgggtcggaacgcctgtttggttcgtggctaatggtgcacggttctgccatacacagttagccacgaaccaaacagggtctgtttggttcgtggcaggcggttttgtcttagggtccggacgaaaccggtatgagccttagccacgaaccaaacatgcgtgtcggattgcactcgaaatgtggccgccgacgacgacggcggtaccgtcgaacttaatgggcctcacaaaaaggaggatagatgggtatgctgctcaagttctcttttcgggcttgggccggacagtccctagaaaccaaacaacagtccctagaaaccaaacatcctaagggccagtttggtaactccggtcatgtgatgagtggcgacacaaacgaacaaggccttattagccacgaaccaaacaggcccgcgccagattggcctccacggactggccgactgggagagaaaagtcaaacgcttgatgtgacgggctaaactttagcagggggggcctgtttggtttgatgccttgcaacgcacgggcacatacagcgggagagcaagcagaccgttagccacgaaccaaacaagcagccggctgcaaaccaggatacacctcgtacacggccgccgagggggtgtttggtttctaaggcaatcccctccggttttgtgggagccacaaaaccggaggggaggaggggattggaggggctagggagctatcccaaacagtgccccctaatcaccaaatcagcccaagggctgatttggtgacccggggacggatacaggacgggacggagatgaagggcgtcggggggggcctgtttggtttgatgaccctgtttggttcgtggctatagctgtctacgatgccgtcggatcggcggcgaggtactccaggcagatcttggcgccgaggtgtctcgcgagctaaacgagccgagggcctgtttggtttgatggcactaaggggctgtttggttcgactgctgacgggagggaagggagggtctgtttggttcgtgacaggtgagtgcccgtgcgatgcgctgctggtcctgtgcgctgtgggcctgtttggtttgtgcctaggtgagtgcccgtgcgttgcggacggctgagatcgcagaatcaccccccccccccccccccacaaagatccctcggtgctccggaaccaaacaggcccataacctgggcctgtttggttcgtggcggccacgagcgtgcccgcccaaagggctgatttggtgactagcccccaaggcaggcatgggcccgagtctcaaattccgacccggtggtccggcggcaggaaccgacaaaccaaacaagccctagtcttgggccagattggagtttcaccaacgacctccgggccgaaggagctatcccaaacagagcccagagcggttgaggtcgtgggcagtcccgcgtgtcagtgaccgaaccaaacagcacgctaagtcggaatcgcgttctttgccgaaagggctgatttggtgaccaggttcgtcgccggagagtcgcccaccggacgcaccgattttcagttcgtttccgtcggattgcaccgacgaagcaggggctgcgaagggctctacacaggaaaaacagaactgctgctgctgctggtttccttatgtccgacggctttcctcacaaaaaggaggataaatgtgaggggctgcaaacagcccaggctgtttgcagcccctcattcgtttgcgtcggattgcacgttcgtttccgtcggattggtaaacttggaacggttctgggcgggggtgtttggtttctatgagtgctcgtgccacgtgctgctgagggtgcgaatgttgcggttgatctgtgtttgtgggcctccacgcccttgacaacctggtatggaacgattccgggtgcaatcggttacgatgtcctatgcgcccaaagatccctcggtgctttgcccctccctccctccctcccagacggtgacggtgacggcgacagggctgatttggtgaccgggtgtccgtgcgttgcgacgggagggtcccgctctggctgattgcttgcacgcttgcacataagaacatccctgtcctggttgtcctgaaccaaacaggccctttcgggtgactggtccagtgctcaccagcgcaccacgtacaggtctcgttccgacccaccaatccagccgagctggattgcttctctagcagcggctgctggctccggcagtccctagaaaccaaatactataggttgtttttcagaaagagaaccgaaccgaagaaccgagccgaactaaccgaaccgaggacaggccttgttcgtttgtaccgtagcagtgcttgcgtgctagagacgaccgacggcggcgtctcaaccaaacgcaccctaagttcgagctgtgttacctcggcgcgccagaaattgtgtgctttgggcatcgttcacgtgggcgagaagggctgatttggtgacccggtcccctccggttttgtggctaaaaaagcactcggcaaagcgccacgggtacgggtttgggacggtgagagaggagagcggaggagctcacaaggtgccacggccccagcgcaccacgtacaggtcggcagcggctgctggctcccacaggcaggcaggcaggcagacacaccacaactgcggcgcgggagggggtgtttggtttctagagtgcgtcgtgcgggctgctcgacaggccttgttcgtttgggtcctggcacgtgacccgaaccgggacttttctggcaagtcgggcgttcgtttccgtcggattatacgaggccgtggaatgcggacggagggctagtttgggagccacgggggtgtttggtttctaagagaggaatggacccatgatgtaatgtttggtttgtggctaactcaggggcagagatccgcgccaagcaacttcttaagttgtgggaagggctgatttggtgatcagccttcagccttgaccaacctcagtcagccgtaggaagttagtgggggtgtttggtttctatgggctcgacagggacttggtcgtttgcaacgcacgggcactcacagtccctagaaaccaaacactttgcaacgcacgggcactgacgggccattgcagagtgggcggttttcatctcccgcagcggttgagtcatgttggctagaggatgtgttggcggctagctcccataagggctgatttggtgaccctcacgaccgtgatggacctaacttagccacgaaccaaacaaccaccaacgacctccgggcagagttagccacgaaccaaacgacgagtccctagaaaccaaaccccgttcgtttccgtcggatggcagcaaccgaacaggcccttagggaaccaaacaggccctaagtgcagagacaggcgtgtgggtccggtacaaccgaacgggcccttttcttcgcgggtacgggtttgagtccctagaaaccaaacacaaagggctgatttggtgatcaagtggcatcgcacgggcacctaaagcggcacactgcgtagcgcgcccgcccgcccgcccgcgtgttagccacgaaccaaacatgtccgctaagccgtcggacataaagaggccagaggcccaatcctagtgctggcacggacacaatattagccacgaaccaaacgtgccgtgggaggccgtgtcgcagatgctcgtacgatgccacggaaggagctatcccaaacagggtcgggcacagctgagcaaaaaaccgggtcttcggctgcctcgcgacacaaacgaacaaggcccaagcgatggcggcggtgtcccgggtggcaagttaggcatcaaacgttgacgccggcccgttagtgccacaaaccaaacaggcccgatgcggtgcccgccgcccggcaagactcagctagtgcttatggccttgttggaggcgtaggggaagtccctagaaaccaaacanngacgacgacggaggcgagaggtcggctcggctcggctctcttggaacaacaggcaccgagatcaggctatctccagcaggtttgaggctaatccaacagacttgggagggctagtttgggagtccacgagctccaggcgaggcggctcatgggccaggctgggccaaaaggcaaagtgtgacaagttaggtacgaggccgtcggagataatttttgacactcggcaaagagagagcttcttcgccgagtgttggctgcgttggtaatcggctgcgtgccaaatggattcgaaccaggtgagtgcccgtgcgttacaggtgagtgcccgtgcgtcgcctgtcccggctactgcaactcctggacaaaatgctcgttgttatagcctatggcgccgagcatcaccaccaggaggagggtacaccctggggcccattggtcagatatagcgccgagcaaagggtccgcgtgctagggtttggcgccagggtctgtttggttcgctgcacgggtgagttcgcctgtcgagcctgtttggttcgtggttaaagtccctagaaaccaaacacgagccgcagcgaacaagccgtggtgtgacattgcagcgtggacggagtggctgtctgcgggattattgctgctgcgggtgattgtcctccggttttgtggcttctaacacaaacgaacaaggcctgaaaactttagcaggagcaaccaatgtttggtttgtggctaaatgagcacgcgtgaagcccgatgacgagccgagtcgagccaccagccggatcggaggatgtcatgagggctgatttggtgactaggtgtttggttgcgagacagccagttgcaatgacaggacgggaccactatgtgtcgtgccgggcctcgtatctggtgagcctggcccgcatctccagagccaggctcgagtcatgttggctagagggtcggcggctacaccggcggctacggctgcggctgcggctggtaacaaaccaaacaagccctagggcaccaagatctgtggcgcctcagcagaaacaaacgagccctaggcaggcaggcaggcagcgtagactgtcttcagcggttgcctccttgcgcacaagatacgttatgtttggtttgtggctaattacgcttgatgtgacccgggctgaagatcgtgtggctggcaagcacgggtacgggtttgggatagggctgactggtgttgggcctgcgacatacgcagggcagccggcgtagcattgggcgtgtgtggccataggctgtggcgccgaggtatctcgggagccaggcccagttcgtttccgtcggattgtagtaaccgtggacgtaacagggagaggtgacgtagaggaggaccttgcacgcttgcacataagggggggtgtttggtttctaggtgaaccaaacaggcccatatatgcggcttgctgcggctttaatccagcaggccatgtaaacgtcttagccacgaaccaaacagtcacacaaacgaacaaggcactagccgcagcggtgtcccctggcagtccctagaaaccaaacgaccgttcctgagcaaccgaacagagatcgtgtttggagcgagctcgccataggctatggcgccgncaaagtaggatgagtcggggggaaccaaacagcacgctagtgaaccgaacaagccctaatgggttggtgtaaccgaacatggcctgagctcgctcgactcgtggctgtttggttgcgagacagtcagaagcacgataggcttgctccgagccacaaaaccggagaggacccgagggggatcgaactcggtgcccgtgcgttgcaacgggaagtccctagaaaccaaatacctctaggctttgccgagtgcttctgccgcaggcttggttcctagcctcgctgggttgctcggcggaagcccagggctcccgttattgccgccggagcgctccaggaaagtcaaacacttgatgtgacgagggctagtttgggagcaatgcaatccggtcaggaatcgttggtaccgtcgaacttaaggttggaggggattggaggggttagagcggtccgctacgaagggggacggtagtgttgagcgccttgacggcgaggtggactaactgcttggtgtaaccgaacatgcccttggtgtaaccgaacaagtcccatagacggagtggtaggggacagtcgggtgggccgcttcaaagtcagccgtaggaagttagctggggcgacgactcggctagcacacaaacgaacaaggcttaaggggctttgccgagtgtcaaaaggctcacgggccgtgcctggattcatcagtccagcaggcttacttttggtgtttggttcgctgagggctagtttgggagccattttttgacactcggcaaaaaattagccacgaaccaaacggccgtcgggattccttccaggcggcacgttgctgccaaactagccctccagcaacgtcctctaaaccttgcatgtttgtgggggcccgccgccgccatcgtcgttatgcggccaaagccgtcggacatagcctcgctgggttgctcgacggaaaaccgacgggaataagccgagtcggtacaggaaaccaaaagtgtgacactcggcaaagagaagggctgatttggtgatccggctctgtttggcacagcttatgtccatcgggtgacggatatgcagactgtttgcagcccctcatgtgaggggctgcaaacagtctgcagaaaccgtcggcccaggattctcgtcgcgcggcttcacgagccacaaaaccggagagaagccgtgcttgggcctgagtcgtctctcagcggcaggctggtgcgtgtccagcgagacgacaggcgtgccgtgcttgggccagcacgtgcaaggactagcagaagccgggcactcggcaaagaagctccgagactcggagagggcgtctgcgcctagagaaggcccactgtgccgtgcctgggccagcactggcccaggcacggcacgcaggggggtgtttggtttctaaagagtccctagaaaccaaacgccgggcgcatgacagctattgcaaaaacaccttccaacagggcaccagcggcccagccacgattgccggtgcgcccatcgccaccaagggactgcactgcgtacatatcggctcggctcggatcggatccctaatcaccaaatcagtcatcggtctattcgggttctcgaagggctgatttggtgaccaggaggcaggcaggcaggcagtgatccctccctccctcccttaaaccgcgcagccagctactgcgccccatgtgagaacgaccgcgaccataaaccgagcaagccaacagtccctagaaaccaaacatatgcccgtgcgttgcaacggaaagcaacgccgtgtatgtggatactattggagttgctcttagcaagggctgatttggtgaccatagggctgatttggtgaccagattagccacgaaccaaacagactggtgcacggttctgcctgcactcgcgagctaaacgagccaagaggcccaaacacgacccgctcgtgccaaccagactgcctcggcagcggctgctggctcccgcggggattttctcggccgagacctgaagacccctgcgaaaggacgggttcaggtgcgggtttaggcacgcaggcgcacttgtcaccaaccaaacgcaccctaagtaatgtttggtttgtggctaacacaggcactcggcaaagaagatcgcagcaccattggatgtggacttgactggctcgtcttattctcggttttgctggtgtgctcaaggcaagccccggtgcatgcacaccggacagcacagagacggaagggctgatttggtgattagagggggaaccgctgcgggagacgaacagggccttagggcgtggtattgccgaagccactggtaactcgacaaagcgtactgtgcaggcaaagtgtgacaagttatgctaatcgtgccgtgcccgtggcccgctgggttggggaagacgcttatgtccgacggtctcctgtgcccgtgcgttgcgacggagttgcaacgcacggacactcaagggctgggaagacactcgcacagtttcaacggtcgtcacacagcggcggcggcggcttcgcggttgcgggacagccaggacagagtccctagaaaccaaacagcgggcctgtttggtttgtgtcatggaacgattccggttgcaatgtcgcgtggtccgtgtgcgtctggtttgcatccgggctgcacggtgttgcgacaccgtctattaggcaggcaggcaggcagagccgtcgtgccgacccatttatcgagggctagtttgggaggctccgtgagttctccgctgctttcctccagcaacgtcctctatatagtagcaacagacgtcttattcgcttggggtcgacttggcttacgcttgatgtgacccggactagggtctgtttggttcgctgactggtttgctgcctaaggtgcgagggtgcgaatgttgcgccttgaaccaaacaggccctatatcgtgcctgagccagagttgtgagaggctgttcaccttggagatgcccgtgcgttgcaacgggggtggtcgcgggcgggtttggggagggtgcgaatgttgcggctgtcctatggaaccaaacatatagctcggcgccaagatctatgtgcggctgcaatccggctgtgcaacgtacggacactcacctaggtgcaagcatgcaatcaaacaccgaccgaccgaccgacctgcagtccacagaagcagccaggactcggcggcgattgacttgggtagcaacgcacgggcatatatttttgacactcggcaaaactcagacgccacaccgcgccacagagccgagccgagctgagctggtcttcgcacggatcgaccggcccaaggcgtccagcaccgtgctccacgctctacagcggttcacgctgacgtggcacgtgagtctgatttggtgaccaggaatctggctcccgctgcccgccggtggtgcaagcatgcaatcaatcgggggtgtttggtttctagttacaaaccaaacaagccctatgaggtgattttagcccctctaacaatcccctccggttttctcgaagggctgatttggtgacaaaacacaaacgaacaaggcctcagcttatgtccgacggtcctgtgaggccgtcggaggtaaggggattggatgcctgctgctcggcgtggaggcaggaagacgagcagttcttgggggccgattggcgagcacggcccagcccgcgattaaagcacggcccgacacggctggtgcacggttctgcctatagttgctccggcacgaggacgtaaccccatccgctctcgggttggaaccaaacaggcccatagtctgggcctgtttggttcgtgcccgatccggaggagacgaggccgcccgcccgcccgcccgaggctttgcaagggggatgctgccgggaacgattccgggtgcagtccaaatcccaacagcaccaagaagctcggctcggctcgctttgtggctggctggctggctccggggagctatcccaaacaggaccgtgcgttcggttaagccctgactctttgccgagtgccagggctgcccgtgcgttgcaacggagtcggcggcgaggtactcaagcgctgcgatgctcgtgcaccgattgcaacgcacgggcactaaccggagctaaggaacggtggctcgtgccgtgccggcactatactgtgaggggctgcaaacagagttggttgcaatgacaggacggcgggtgaagcggccacatcgacacccccccccccccccccttgtccagtacggttgctccactggtaccgtcgaacttaatgttggcactcggcaaagaagcatcacagcactcggcaaagaatttggagctatcccaaacagggccttggttgcaatgacaggacgattagccacgaaccaaacactgcaggaaccgccgaaaataggcggtcgcttggaggctaagtcttgaaccaaacaggccctaaagacacaaacgaacaaggccagaaggctaatccaacagactctgccacccacccacccacccccatcggcaaagagccaaatttcgaggcaggcaggcaggcacgctggaggggattggaggggctggcaggccttgttcgtttgtgccagggctgatttggtgaccatggctgcatccacacgtacgtctcgtgccgtgcttgggccgtgccctgtttggttcgtggctaatagactgtcttcagcggttcccgcggcagtgccctctcccacgcgaacccctgccccacccatacccatgtgagaacgaccacgacgaaccgcctgtgatgtaaaacatcacaggcggttcggttagaggcggtgaccgaggaggcgcaggtgagtgcccgtgcgtcacgctaacaggctggcccgacacggcctacgggccgagcctacagcccgtgcgttgcgacgacacaggctggctggctgcgtggccaaaaagcactcggcaaagaagagggctgatttggtgacaagagcagacaacgacgacggcgtcaacccagcctgagcacgactaaagatccgatcagatatgtgtaaaaagacagtggtagtatagctagttttgcaactcttttttactctagtattgaagtggtttaaaggtcaaactaattataaagtggacttcgcgcaggatttaggatctggtttcgactaatttgtcaggattcattccagctcaacctgtgatgtgtgactatcaggaacgattcctaaccggattgttgtcggctggttgcgcccgtttttggctcatgccctctagcactccatattttgatctatcgtccagcactgacttcgacacgtggacttcgcgcaggatttggtggacttcgcgcaggatctgaactttgcactatatatagagtcggcaagtcatccttggctggctataggctatggcgtcgaactaactactagttctagtgcacactccatattttgatctataggagatattgacgcggctcaattgagccgcgtcaatatctccgaactaaccttaggcacaaaagtttatgtcgctgatttgtccccgctacatttggagggtagagtggacttcgcgcaggattggatcttcttgcgcctctactgcaagatcacatcaatcccttggttgttgtgcttagtccggctgagctaagcctgcgcgtggtgcacaattggtcatcgcgcttggtctcttgcccttctcggactggatatagggttgggcctctgaggaaatagcattatgtccgacgtggacgcctataccatagccgatatagggttgggcctctggacggtcctctaaatttagaggccgcattcgtgcgtgaggtggaaacggttctctatctatttggaatccttgccgtgttcgcggaaaagtcaaacgcttgatgtgggcatgtcgctcgcccagatgggcatgtcgctcgcccagatcggcatgtcgctcgcccagattcacgagcccggcacgaaataaccgatgctcggcgccataggccctaagtcacgcctcaggggcatgttcctacactatgtagacgtagttgatagccaaggtcgcaaaggcactcggcaaagtatagtaagccagcgggcggagtctctcggcaaagaacctaacatgtgagcctgtaagcgctgggggccacatcggctgccacgtaggcagtctttgccgagtgccaacacagactttgccgagtgccaattagctggaacgattccgagtcgacgacgaagggcggttgcgtagggctagtttgggagccactccagaccgggctgatccacggtcattgttgtcggtcctccttgatgctgcggtagtggtccctgggcgcagtcttcgccgtggaggccgaaacgtgctcgtggacaagtgctcggcgaaaggccagttgttgttgcttcttcatataaaagacccatgttggtttgtgtcgaagacctcatagtgactgacattttggacctggtgcgtgcggacggctggcgtgccgattttgccgagtgccgccgatctagggagaccgaacgggttcaaaggccttgttcgtttctgtcaagtccgacaaggccactaacaccttgtgcaggcaaccaaatacccgtgcgttgcgacgggaatacgtctttgccgagtgtctccgtcgaagacctcatagtgtttaggccgaagcctatcagacagaaaacactcggcaaagaaactaaaacactcggcaaagactctttggtttgacttcgagactgcacgacagccgtcggacataatccatagcactcggcaaagaacagagtgaagcaggctatccaacccggtcgtactcataaccgccgacctctttgccgagtgcctcaagatctatggcgccgaggttcaagatctgtggcgccgagccagtctttgccgagtgccagaagctcttgctgccgactgagttggagaccgtgctgtcatcgactggcactcgacaaagaagcaaagatgtgaccacgacttggtacccagcgggtggtccatttagacgaggagttcgcgaggcagaaggcggcaatcgcctcggctcaaagactttgccgagtgccacaagcccgaaaaggcccgtctcacacttttcccgccgcagttcaattcgaacgactaaccttaaggtgcgcgcagtggagatcggcattcatgtgcattattgcaaggcactcggcaaagaagttatctgggttgaacggcggagattgaacacgactgagtgcagggtaggatgtgtttggttggatgcaaggtcgaggaccctgtggtgtgtacgccgcagcacgggcgccatagcactcggcaaaaaaggccatagcctatgacgctgagtttctttgccgagtgcccgtgaggctttgccgagtgtccagcgagggtcggctctgataccattggtgttaagtgccggtgggctaagcttatgtccgacggctacccgtgcgttgcaacgggacccacaaacgaacaagaccttattgggcccaataacttgggaggatggatcggctggtcctggcaccaagatctacggcgccaagggtgtaagcctgaatgacttgtagaggccgttgtcgatgatcggtgtacccgccccacgaatctcccgtgcgttgcgacggcttaactccctcgggatgactgcacgtaagccagcgggcggagcctaaaagactcgtgttggtctgtccctgaagcggctcagtgccacgtattaggaacgtgggtacccggccaaaccacggcgatctgttagctggaacgattccgggacacaaacgaacaagacctaagcttgctgagttgctcgataggaaataagctgtgccaaacaggccacatcggctgccacgtaaggcacatctacaccagcagcactaggatgtgtttggttgcaggcataggctatggcgccgagcaaggctagtttggtgtgtggccactccctcgggatgactgagttggacaggaaaatggattcatgtcgaagacctcatagtgccgaaggccttgttcgtttgtatcctttgccgagtgtctgcaccagtgacactcggcaaagagcccgttggctagagggtggaaaagttcagtgactggcactacagaaaaactttgttcccaaacaccgacgggaattaaaataaagccccgtggctagtctgcgctcgggaagccgccgaaaataacctagaagccgccgaaaataaccacgtcatggatgagaggagagtggtctcagacacacggcaaagagtctgagacacacggcaaaggttctttgccgagtgccatttgagatcttggcggcgaacatccgttaggaacgtgggtacccatacatgtcggggctcagcattcaaactttggttgagaccaattttatgtccgacggctttggtcgccacactttgtctaagcttaggcaaagtgtggcaagtgaggcggccaaaccacggcgatgggaaaggcactcggcaaagtattaaaagcactcgacaaagaaaacacaaacgaacaagaccttttagaccttacttaaggcccaggtagggctagtttgggagtcacgaagatcgggcatcgtgacgcgttcgtttctgctggaacagagtccggttagtatagtgccagccgagtgtcggcgaaatgcaacctcgaggatgctgacgcaatctgggccaattgcgtctttgccagccgcagtcggattaggacacgagtcttttgtgcgcacttgtctccgccatctagcgacgttcaaccagatcgcgccccgctaagactgcgcagaagtcaaacaaacgaacaaggcctaagatgtaggccctgtttggaagcacccactcggcaaagaacgcgattagccttctttgccgagtactttcactctcttctgtcagctttctttgccgagtgtttttttcgttttcagcttcggctctggctatgcggcggactgtgctcgttagcacggcactaagcctgctttgagcctgtaagcgctggtggtggaccgaaggcgtggcacgacggccaaaccacggcgacctacgtgggtacccacgttcttatcggccaaaccacggcgatctagcgtcgtcctcctggtgtggcctttgccgagtgccagccgttgctaacttcctagagacggccccatagcactcggcaaagaaaccatagcactcggcaaagaagcaagcaagattggtcggattagtgagtgtccgtgcgttacagatctagatctaaccgaccaagagatcttggcgccgagctgcgtggcactcggcaaagaagcaatgcgaaggccctgacgctgtggccgagatgccagcctaaggacatcctgcagacggcgtgcatccctgaagcggctcagtgacagcttctttgccgagtgtggtgaagcccggcacggctattggaatggcctgtttggttcgtggcgacgacgacgacgatgacgatcagagcaggctcaatggacaaagagcaggctcggatgagtgaagcctttgccgagtgtcagttttagctggaacgattccggatttctttgccgagtgccagatatggcactcggcaaagaagctcttctttgccgagtgccaaagcgaagactggtgcacatgatgctgatgctgcggtagtggtctcgagttcagcgaaggggacctcgacacaaacgaacaaggcctgagccagggatgatttgcctgtgcaacccagggtgtttgaagcaggtgagtgaccgtgcgttgcccaagatctacggcgccgaggttctttgccgagtgccaacgttgaggcgaaggcaagcttgcaacttcgccagtgcttatcagcgaactaagtcgcagcgaggtcccatagatcttggcgccgaggaaagactttgccgagtgctgatggaagccatcggatgccggaagccggatgtgcttgctccgtagcctttgccgagtgtcacctcgcatgacgaccgttgaaaacaccggcggtgagattgctccgacagctggtatcggagcaaatgtcgaagacctcatagtgtcgaaacacgactgagtgcagggcaagagacctacttgcacgattgtgtaagcgatagcggcgagggctaacttcctagaggcaaccagagcaggctcggatgagcaaggcgagacggactgggcagagttggcgaagtcctgcgtagatgagtgtctgctggactaacgcatgtccgacggcccgccacctgttcttggccctatccacatgagcctttgccgagtgtccactgcattcatgtgcattatgcaaggcgaggttgacgacgagatacaatcaggagcattttgggtggacggagacagcgtcttcgcccggctttttgccgagtgttaagtgagaggctgcaaacattttaaacactgtgttgtgggtccacgaccaaaaaatactcgggcccgacgactttggccgtcgaagattaggagcgtgggtacccactctgctggtgtgagatggtcaccgacgcaaacgaacaagacccgtgcgttgcaacggaaccatccgaattccgtccacgcccgggtgtaagcctgaatgaccttcagccttctttgccgagtgccagctggctccgtcttcacttgaactggacatgtttggtgccgcgtttggtttgtggctaaatatccgacgcaaacgaacaatgcctgaacccatgatgcaccaccttagggctagtttgggagccagaagcactcggcaaagaaggcagcttctttgccgagtgtcaagaaacaggaccttgggtcttagatgtgcccgtgcgttgctacgttatgtccgacggctttgtccgtttcggcctaggtcttagctaaacctaaacacacgacgtggcgacctctttgccgagtgtccaaaaccggttgaaccgccccttcacaaaaatgaggataggccgacgccgaggtaacacatagtagagcaggctcggatgagtgtgtagtgcttctgagtagagtcctgcggctactgtgtccggtgggcgacgacttcgtacggcgaagctgccaggagtaagtatcagtcatggatgagaggagagagtcagtgactggtactgcacgggcagcccactacggtgtagtaggctcgaccggattgcaccgttgatgctgcggtagtggtcacaaaagcactcggcaaagatctaggccttgttcgtttgtgttggagggtgacttggccagacatgccgactactcctacaaattgacagctggtatcggagcttgtgagcttgactctagtccgacttacgaccgatttcaggagcggagagcaggctcggatgagagatcgaggacgagctgcttgtccctctgcagatctcccgaagactagcgacgttgctttttgattcttgactctagcgtccgaggcacttcgccgagtgtttttcagcagctgacaccgaatgccatactttgccgagtgtctgcgatcctttgccgagtgccagctggactttgccgagtgccagcagggggcggtctggcgaagtgagacccctacctggcgcgccaaatgtagtcggttgtccgtgcgttggaaacgaacaaggcctaagcaatcaggctgcgttggtaatcattctcgaacacgcaggagagtagcaagtctgcgaggcgtggcgatgcattttgcgcatgggagggcgacgacttcgtacggcggcccgtgcgttgcaacggagaccgctgtggacttcgcgcaggacaagcccgaaaaggcccgtatctgtgccaaacagggcctacgtctcgagacttcggatggacgctccgcgatacggctgatcaggggtgttacgctccggcggccggtttgaccctcaagtgacgaagggcctgattggttgccgtaatgtgaccgttgatggacgtgcttcagttgtggcaaggcggaccatagcactcggcaaaggattcggcaggaactgttgtcttttgggcgcagtcttcgccgtgactgcgcagaagtcaaacaaccgcttctttgccgagtgtcaaatttcggtgacgcacttaagcatagggctagtttgggagccccaaaacgtctatggatgcagatcagtctttgccgagtgcccattttctttgccgagtgccaccatcgcgagctaaacgagctatctggcgcctgagaatccatggtgctgatttggtgaccagaaaagtgacactcggcaaagacgccccattgcgacggcgcatggtgggcaaagactttgccgagtgccgtgctaaacgggccgtgccctccaacggagcagctaaatggaaccgcttgtgatgtgtggctaccaaaacgaccggatgtgagtccgttgtagtctagctagttcaagtgctcggcgaaaggctactccccgctcaggcggaggcccccgtgcgttgcaacgagaacctgggccaagcccattccagcattgcaaccatcagtattatgcgtgcgttgctacggagttaagcgagcgtagttcagtggtaatgcttatgggaagggagacggccgaaccgaaccgaagaaccggattaccaaacacagaacataaagggtgcgtttggttgtggactgaattaagtccgacggctccgacgagaggaaggaggacgcactccctcgggatgactgtgtttctttgccgagtgccacggtgctaacttcctagaggcgacccgccgcgccgggccgccacgaacagcctatggcgccgagctgcaaagacctcagacagctatggtacattcgggccgcccggtcaaaagcactcggcaaagaaaaggtggtgtgtgcctgatgactccagtgacgggaagacactgtgatggacggccaagtcactctcactcgacaaagaaggctccatgcgctaacagacgtggagcattatgtccgacggctttggccggccactgcacgacggcagtcaaaagcactcggcaaagccacgggtacagaaccctttagggtagaggaccgtttagaggacgcgtgttttgcggagacggatgcaggatcccgcttgtgctcttgacactcggcaaagactttgctaaaacactcggcaaagagtttctgcgcagaagtcaaacagccgccataggctatggcgccgaagttggagcggggtgttttgttcatagcctatggcgccgagctataggctatggcgccgagcttcctagctcggcgccaagatctaaggctttgccgagtgtgacagtgactgtgagagcgggatggaccacattcgtttctgccctcaaggctttgccgagtgtattcataggctatgacgccgagcaagtagagatggcaatggggattattagcgggctggtgctggcaatcgctgcgacccgcatcggcgcactcgacaaagaaagcacagttgctgtgagccaggctctacttgcaggtagaagccatccgcttccgacgggacccgtcttagctgaatattggctgcgccctgtccgacggctagactgaccacacgagtcgagcgagctcacctgggccgtgcccgtccggcggagtgtgacacagttagccacgagtcttttgtgcgcactttgtcaagagccaagaacgtcgtgccgcacttgttgtgctaagtccgagagccacaaaaccggagagaagacgaagctagcagcgcgatggcactcggcaaagaaacttgcagatccgaagacggggtgtagcggtccttctatgcaaacgcccaagaatcaggtgaagacagcgaaggttgtcgacgttccaccccccccccccccccccatcaagactggagcatgggagcaggcgggtttgggtgtgagtttagggcctgtttggtttgtggcgtcactcgtcccgcaaccgttcaccgctgcggctataggtcggctaaacactgtgctatgagtccacagatcttggtgccgagctccatagatcttggcgccgggcttctttgccgagtgccagctgctttgccgagtgccagcgtgcctgctctgaccggcggcgcacacgcgatcgaacacgtggaagagatcttggcgccgagctcggactggtttattgggctgcaaaagcctcggcccatagtgctgagagggctgtaaacatcgtggtctggaccgtgctttttttccgcgtgcgttgctacggagtcagcatagtctatggcgccgagcagggctaacacggcacgttagattctttgccgagtgccaaaaaacaggctatggcgccgagctaatgcgggtcgcagcgatggcggcagtgaccgcacttatacccacgtggggcagcaggctgctgtaggccctgtttggaagcggatttctttgccgagtgcccgatcggcaaagcctttgtcgagcgttttgtggctcgtgtgctaggacactcggcaaagactttgtcgacactcggcaaagactttgccagctgacaccgaatgccgtgggtggtgtgtgcctgatacctcgctgtggacttcgcgcatgacgtgcgttgcaacggaaacatatcgcgatccattaccacccccagacgccgccgaaaataagccagacgccgccgaaaatagctacactcggcaaagtgactcaaacagcctatggcgccgagcatcctgccaaacaggcagcttctaatgactgcagcggcgcctgccgagtgcgacactcggtaaaggacaaacttgtgttgtggcttgcttctttgccgagtgtctgctccgacccgacggattaggataaacacgactgagtgcagggtctcgcgcctctactgctgacgcgtacatcgctgtgactggcaagtgagaagttgccggccggcgaggatagaccccacccgcagcagtctacgggttccttagagcagtctttgccgagtgctttgagcactcgacaaaagaaagcaaaatctaacccgcgctccctgaaggctttgccgagtgtttttaaaacactcggcaaagaacttggccgacccatttatcgggcccccgtgcgttgcgacggcatagactctggtttcggctaatttctgccgttaatcgatctggacgccacggacggtccagatcgatgaggccttgttcgtttgtgtatcaggctgcgttggtaatcgcatcctgcagacggcgtgcctagccttctttgccgagtgcgaactcggcaaagagggctttgccaagctttgccgagtgccagtacgggccacgagtgaggcccataagcttatgtccgacggtctacgattccgggtgcaatccgataagcttatgtccgacggcctgagcagacacgacacagaggtggagggcaaggactcgcccccgtctgtgcgttgcaacgagaaatccgtcggcttaggactaacctttgccgagtgtttttttatcggctttttgccgagtgctaacactcgactgtccaacccggtctgtgcactggagcagcatggagctgccaggagtaagtactacaagctttgccgagtgccctcccggcacaactaaacaaggcctaagcttatgtccgacggccggctgaatattggctgcgctctacactcggcaaagtgaccagtcaaacgaacgcagcctaagtgggcgacgacttcgtacgacggtgtcgaagtcagtgctggaccctttgccgagtgccagcgatctctcagcaggaaatcagcaaggctaacttcctagaggcccagaacgctatgtccgacggcatcacagccgtcggacataatcttacggcggctttgccgagtgtctttctttgccgagtgcaccctagcgaagctgaggcgtgctgccggaccgtgctttgagccagtgactggcgggacacgtgtacaacactcggcaaagacttcgcccggccggccggccggccaccaggacaccatgactggcgcagacgctgtgactcaaccttgcgcgcttctttgccgagtgtcaatggagctgggcgcgtgggcgggatccgaagccatctgccatggaaagatactgggccagtttggcgaccgttgaaactggtgcttttggtctaaccgaacaagctcgtgtaagcctgaatgacttgccttgcggcttgcctgcccggttccaacggtgctgcgtcagggcaacggctagttgcgtctagggtatccgacccgataggaccgaagcactcggcaaagaagccgaccgttgcaacgcacgggcacttggctgagtctgtggcaggctgtgggggaggcgagggatgggcttacatctagtatctgcttgtcgaagacctcatagtgccacccgtgcgttgcaacggaaccgaccgaattccgtccacgccctgatgctgcggtagtggtcctgtttgggatggctacaggttcgacactcggcaaagactttgtactaggtgagtgcctgtgcgtatggaccccacctgtaggcgcacagcctatggcgccgaggtagttgagcgactccgacgatttcagcaaaactgagggcaccagcagccagcagaacaagacccaaggccttgttcgtttgtgtcatagcctatggcgccgaggtaccggctgacaaccgacgggtttataggagttccgtagttattgcttgctgagttgctcgacgggcagcccctcacaaaaatgagggtcgctctaaatcgctacaggtggcactcggcaaagaaagcttttgcgtggcactcggcaaaggatgcttccatcatcacagcttgggctgatttggtgaccaggatgtgaccgttgatggacatgaaatgacttgagaggtgtaggaggcactcggcaaagaagtttacgtctttgccgagtgtctgacagacactcggcaaagacgtccgtccacgcccggtcgtactctcggcaaagtcctgctctcggtagggctagtttgggagccgtttctttgccgagtgccacccaagcctttgccgagtgtccccgtaagcttatgtccgacggctggtcggaccaagattccacgatgttggggtcatcacaggccgccagaagaatagacgaccagccgtctgtgcgttgcaacggagaacctcatcgacggagaccgtggccggatttcggcggaccattgcgatgatgctcgctggggctgtgtaagcctgaatgacttgaggagactctggcggtcacgtctgcgctaacagacgtggggcagagactttgccgagtgtttgggcgtgggacgggcttagcaccggcgtcccaggcctccttgaagaagatcgggcatcgtgacacccatagatcttggcgccgagagccaagatctatggcgtcgagcaagcggcagaagcgggaccactcgcgcagtggctattgcacacactcggcaaagactttatcgactttgtgtgcggtgtggcctgcttggactttggatcgctgacagcctatggcgccgaggtttagggctagtttgggagcctagctgatttggtgaccagagatttgcagcggaaatcttattaccgtgggtacccacgttcttcgccttgaccctgactctgtaccattctagtttgcagccgtctggattgaccacacctgtaggttgcttctttgccgagtgtctgaacagcctatggcgccgaaatccagacactcggcaaagaagccctggcactcgacaaagagtattttctttgccgagtgccctacacgacgaagctgggcgagctcgaaggccgaagaggagaaaggcaagcgctcgacaaattgcttttttacatcacaggcggttcatagtccctagaaaccaaacgtctttgccgagtgccagcaatccgtgacgtaagccaacgagcgggcaaagtgtggcaagttagcactccctcgggatgactgcgtgtgacactcggcaaagagattacctcagttgccacatttgccgaagagttgcctactcctccaaggccttgttcgtttctaccgaaaagcactcggcaaagccgcgacggcgacagagtggacggagcttctttgccgagtgtccggcagcactccgcatgcggctccaaaagcactcggcaaagagctactcgacaaagcgccctacaggtggctaagaggggaggttcttggctctcggcaaagactctcaaggctctcggcaaagacgtcacaaagacgtctttgccgagaggaccaggtccagacgtctatgctaacttcctagaggcggtctcggcgtggctaaggttgtaaaatcatcgcgtgcgttgacttaaaagcactcggcaaagcgcccggcactcggcaaagccggatagctgccaggagtaagtacgctaggatgtgtttggttggggagacactcggcaaagactttggtgttttgccgagtgcctcctaagcctttgccgagtgtcaccataggcgagtcgtgactgcgccgaaacgaacaaggcctaagttcactcggcaaagaacccgctagacggctatactgacagccataagcacttgagcagccatattgcctcgggcgactactctgggagcaacgaccgtcgtcccagccgcatgcggccacgtaggactttatgtccgacggctttcagaaaacgaacaaggcctaagccaacctacagcggcaggaatggcgccaagatctatggcgcatgactcgggtgcgcatgagtaaggacctcagttgccacattttgctttgccgagtgccgccgtgacgccgcctctaggaagttagcggctaacttcctagaggcggcccgcactcggcaaagaacctatgcggtgtcatggttgttctggatcgtcggggtagcttttgtgacagccgtcggacataatggaaggccttgttcgtttctgctgctgagcccggaggacttggaagcttctttgccgagtgtcatctttggacccttagctcggcgcgcttctttgccgagtgtcccactttgccgagtgccagctggtcagaccgtcggacataatcttacgcagtcacgactcgcctgagtgatagtcttttggatgattcgagcagtcatcggacagcggagccttctttgccgagtgttgttggtcaaccaatccattcctagctcagctcaggagtgatccgatgtggctcggcaacgataagcgatctgattggtccacgtgcccgtgcgttgcgacggcacgaagacgaagctagcagcgtgagaggaggccgtagaaagttagccgtgtgaagcagaccgcccgttatgtccgacggctttcctgatctccagagccaggctcccaaaggccttgttcgtttgcatcccgtgtctatgactggtgggaagtgcctaagtcacgcctcagagccttctttgccgagtgtcagtcagcagatcacgagcagtctccacgtgcggctggactgtgacctcagttgccacactttgtatggctttgttggagaggtgagtgagccgtcgcaacgcacggcaaaagcccatataagtggatgctgactgtagcccctaggaaaaaacactcggcaaagagccactgcttgcctgctgctgaaatgattagtgggttgtcgccagaacttcgccagtgcttatcaaccttccgtacaatgtgctcgcgacagacacgtcatgccggcttaaccgaacaaggcctaaatgggtgtcaaaaacaggtggtggccgtgggtacccacgttctgaaggcaaagactttgccgaggggagagtgactccataaaccaatcagacactcggcaaagagtcttaggctgtctccagcaacgtcaagggtgcgtttggttgaatgagatcttggcgccgagctaccatgaacttgtgagcgtctgagcaaagactttgccgagtgtcaacgcgatcgaacacgtggagggtgacacagttagccacaaacgtgacactcggcaaagagtctgggaccctgttgtgagtggccaagcactcggcaaagaacctggaaagtcaaacgcttgatatgcccccccccccccccccaaaaaaacacgactgagtgcagtgcgccaagatctatgacgctgatagatcttggcgccgagctagccaagtccgactcaactttgcccagcagcgtcccctaaattcgagagagagacagacagacagaccatagatcttggcgcctaccgccaagatctatggcgcctaaggcggtctggcgaagtgtgatcaggactttgccgagtgcggctttctttgccgagtgcccgcgcaagatctgtggcgccaagctgtgccacagatcttggtgccagcaacgacttcatacggcgggggggccgtcggacataagcgcatagtgccgtgcctaatagtgtgctcgacaaggacctaatcgtccgacccaccaatccataaccaagttattgggcccacatgcctggcatgtgtctgggaagcgcaagttattgggcccacgtacggggccgtcggacataagacgaatcggggtggagcgtaaaaatccaatcaggatctcggtagacagacgtagggcggctatcccgagctgagctggttcctgtcacaagttattgggtccacatgtggggccgtcggacataaggctaggcgtcctcagcgacggacttgcccgtgcgttgcaacgagaactttaccgagtgcggctctccaagatgcagttggtggacgaccaagaggaggaccaggagcacctgacatgtgggcccatgaactctgccaccgtagaccggccgaacagggcctaaggggagtcgcctcggtttgctgcgtggacggacggtcgagtgggatggagagctgtccacgaggaagaccaagcactcggcaaagggaccgactggtgcgggtgcctctcggtgtgaagatcgggcatcgtgactatcgggcactcggcaaagaagcttatgtccgacggtcttctcgataccagctgtggcggaacgtgacactcgacaaagaatatttggttgcaatgacaggacagcgttgcagcgatggcggccagttgctccggcacgaggatgtagcttggatcacgtctctgtggacaaaccaaacaagcccttactctcggacgggcctggctgcggctagcactcggcaaaggcgagctagcactcggcaaagtcgcctgggatttggacgttgttgcgaagctgctgggtggcgaagccgttgctgggcgcgttgaggagtcgtccgtcctgagtccaatttgcaacgcacgggcactgagcaggcactcggcaaagaggctgcaaacgaccttcgggctgggcagcacgagcacgacccgaaaggttggtcacctggctgctctttctttgccgagtgccggatcctctttgccgagtgccagatgcgtgctcgggctagcccaacgtgcaggcacgcacctcacatcggggaaccgctgcgggagatgtgcgtttggttgcgggtcagcgtgctcgtgcgtcacaggccccgaactcgaggtggcgccgctaggagcccgacgtctgctcgattctttgccgagtgccgtgttaagcacgagcaactggctagtgttccaggagtgctccaggtctttctttgccgagtgcacgagtccggtgaagtggtcgaggacggcgattccacggctaggttccgggcactcggcaaagatctgcgaggctgaggccgagctgctagcaaaacgcttaggcccctcgacactcggcaaagaagctttgaggacaaagtgcgcacaaaagaccctcgcggtttcacgggctgagcgatttggcggcggtgggcagcggtgcggcttcaggcgctctttgccgagtgccaaatggcctcgctgggttgctcagcacaggcactcggcaaagaagttcccggtggcagggtggtaggccaccacctgctgcttgaccgacatacggttatgtccgacggctgtactgacccttgccaccggctggtgcgggtgcctcttggttccacggtctgagccgccagccgtggaccgagcgattccggcgttccaggagtgctccaagtcgacgacgacgacgacgcgcccgcaaacaaccattaggtgcaaaacgctgcatgtgcgggagcaggcgggcgagagggaggcgagcgggcgagagcgaggcgatactgaggagtcgtcggaggaggaggaagatcgggccgcgtctacccctctgggtgagcgcgatttctgattggatgaccgcacccaaggggcgagagtggaggcgagcctcggtccgcgtgcaagataaggcgacttttgctcggacgctgaaccaaacaggcccttagtggactaggcaggcttttgcttacaagccccgactcttcgctagtgtctgagacacacggcaaagcagattggtcgcatctctagcaccctaaacactgtgctgtgatcattggcgggtggctgagaccagcggggtgctggttgggcggcgcgcaggctgcgagttgcggggagtttggctggggcggcggacataggttgatgccgtcgcgccagggccaccctgcagatctgacaagcgatgtgccgcctgactgagtgcagggcgaccagctggattaaagccgcagcgaagcctcgctgggttgctcagcggatgagtaggagggcgcggcgtttttgacactcggcaaaaagctcatgtgcgctgacgcctatcttccgcaggagaggaccaggcataaagtagcgcgtgcacctcttgaccatgggagccagcgacgttcccggttgcaactcgattttttgacactcggcaaagaacccgacctcgacgtgcggtggcgtcgtcctcctggtgtggctagggttgtgggccgttggatgctctttgccgagtgccagccgtggacgagcggctgtaaatgaggcaaagtgtgacaagttatgcatggtcgtcaccgtcgtcctccacagatcttggcgccgagcaggcttcgcaggaccttgtgacgacgcggcttgcggcggtggcgggcactcggcaaagaagtcgagtcctcgacgcagggccgcgccgaacgcgacccagatcacccacgtatcgtggactgagcaccgcggacgctgtcgagcccggtggattgggtgggattgagtgacactcggcaaagaagtaatcctactgctgttgggagggttctactgccgccgataagccccctgtagggcgaagacgcggtcccagccagagcgcctgagtcagctgtccaccctgagttccacgatgttcgagcgagcgatgtcggtatagagtgccttgctgggcaggccttgttcgtttgtgtcaggcgacttttgctcggatgagtggcagggtggtaggccaagtccaatcccggaggcggtaggggtgaagcgaagggtgagactgccaagatctacggcgccgagcttggcgactgccagttcgaccaaattggcacggcacgaccatgacggaactgttcgcggggaaagaaccgcctgtgatagacagtgccggtgggctcggccttcgccatagatcttggcgccgagggcgtcgtcgtcggatgtggtgaaccgaggaaccgaaccgaacgctcaggcggagacccgatcattacgctccggcggcccgaaaaccgaacaagccctaaggtgagaacggagccgttccattcccttctacgcctagcactacacctctgccaccgtagaccggcttgagtgcccgtgcgttgcaaccagccaggctacggggagaaggtgttggtcgattaagacagcctctttgccgagtgccaggaccccttcggtgcgccgccggccgtgacgtaagccaacgggcggcatcacaggcggttcggatagaagaaccgcctgtgatagtcaaggctctgggccggtggggtcgaggacggcggcgtgatttgcttccttatgtccgacggttttcgggcactcggcaaagaaggagtcagcagggtggacaggcgacccgtgcgttgcgacggctcagacactcggcaaagaagctctactgttggactgcgggtttctcgaagtctttgccgagtgtgaagcctttgccgagtgtcacggcataaagtagcgcgtgcgcctagggctgatttggtgactagaagagctgccaggagtaagtatggaggcgtaggcgagggattacactatgtgttacctcggcgtgttcgtttccgtcggattggggttgccgatgtacagttcgccgagaagccagtccacggtcgtcacagcctatggcgccgagtaaaagcactcggcaaagccccggagaagccagtccacggtcgcgactgagtgcagggcgactagttgcaacgcacgggcacccattcgcgaaccaaacggcacctacgagcactcggcaaagaaccgcgtgcgttgctacggaatcaacctgtgcgacgttggcctgaccgggcactcggcaaagatggacgtggtgcggtggatgcgggggataggtcccacccgcaggtagggggtgtttggtttctggggcataggctatggcgctgaggtgtcgacagtctatggatttggcgaaccgcctgtgatgtattagtgtcgtgcctgggccatgcgagatgtctcacggcggcgctgccgcgatacggctgatcagcacgggtcttcggctgcctcgtgctctccgcacaagactgcatagtgaagatcgggcatcgtgatcgggcactcggcaaagaatttccatagcctgtggcgccgaggatatgcggacgccaaatctagggtaccgtcgaacttaacattgagcctgacgtaaggcccatacccggggtcgaaacgccgacacctcgttcttggccctatccacctgcggcttctgtttgcgacagtgccggcacgacacgacaaggttccagtggattgagcgccggcaaagtgtgacaagttagattgcaacgcacgggcactcaactttgccgagtgccagatcacgacctctggaagcagtcctaccacctgccggaaaagtacgatctggcattgtgacgtgtggcgttgctccggcacgaggacatagcgagccaggctgtggagaaagaacgtgacagcacatgcgacgctgggtccagcgccaggatcgtctcaaagacctcagacagccgagccagctcgcgagctaaagagtgtccgtgcgttacagtgcgccggctgagggaggcgtcgcccgtgacataagccagcaggccgcgctcggccggtcaggcacccacttgttgcgggcgcacgcgaagactcccggagctcgggagggctgatttggtgacaagtcgccataggctatggcgccgagtaacactcggcaaagaagatgtgaagccgtggtaacaccaagtcacactcggcaaagacttcgttgcaacgcacggacacccaagagcccaaaaaacccctcatctctttgccgagtgtctccctcgggcactcggcaaagaaggcctggcactcggcaaaggaatcttctttgccgagtgccacgcagtgctttgccgagtgtcaggaagccatctttgccgagtgctgtgggctcgggcgaggcgtagtccagccagagcgcctgagtcgagagtctccccgagccaaccctgaaccaaacaggcccttaagagcaggggcaaaccaaacacccgttcctgagcaaccgaacaacgctcaggcggagacccaatgccacaaaccaaacaggccttatcgcgggtatgggtttgtctcggagtcggcggatgttgcgagtcgtgatccattaccacacatgaatcgctccatccacgaacgcaccaccaggaggagggaacggacactcggcaaagaagccccctttgccgagtgccagatcgcgtagcaacgcacgggcatacacgcgtcagcacgcgactgtggagggctgatttggtgactgggcactcggcaaagaacctatgctggcaggtccgcgcagttgctactattggagttgctctaataggctttttacatcacagacggcaaagtaggatgagtcggggccaatccctggaccggcggtacgttgtgctagtccggctgcaccgctgactacagggctgccactccggtgaagtggtcgagggtgaagtcgtcgtgctgcgtagcgctcaggaggtagccccagataggagcagctcatgccggatcgtgtcgtgcctgggccaccatgtgtctatgacatgtggggcaggtgcaagcatgcaatcgagcgacggtcacggcgatgtgcggcaatccagggagcttcggcattccgttgttggagatgccctcctctttgccgagtgtcttccagccctcggctcactggagtggggccagagttatgcgctgggccgtctcgaccggagtctgcctttggtgtaaccgaacatgtttagagctgccaggagtaagtactccgcgatatggttgatcggccgggaagagcatacctgcagacaccctcgcgtgcgacactccgagcctgacgtaaggcctcgggagctgacgttgacgatgaccagcgtcagcatgttgcgtccagggctgaacgggccgtgcctagggttaggggttcgggtatatgaagctgctgggtggcgtacttgcccgtgcgttgcgacggcatgccaggaggaggtctgcgcccgagacttcggatggccacgagaactggaacaaagcggctctattgcactcggcaaagacacttgaaccaaacaggcccttaatagcgtggactggcttctccggcggaaagttgatgagcagccagtcgaagcgaaactcgggcaacgggactgcagcaatgagggctccgaagccatctgccatggaagaggactgtttagaggacgattgcaacgcacgggcacccaccgagagggaggctgtgcactgagactcagctagtgcttttggattgttaggctaactccagcacggggattttctcggccggacacagcactcggcaaagaagctgaatcgtctgcttctcgcaaccgggcactcggcaaagacgttctgcatagatgggccggtcttggtacaaccgaacgggccctagagcctgacgtaaggcccacgcccctccggttttgtggctccagctgaacgatcccttggggctcgcgctatctgccgggtttcgcctactctctggccgacgggctccaaaatcgccgtccgcaggtctttgccgagtgcttgtcactctttgccgagtgccacgcagactgagtgcagggcgactgggccaatgatgatgacgccgagggcactcggcaaagaagtttcctctttgccgagtgtctagatgcctcgtacagggccgtcggacggcgaagggtggggttggcttgcccgtgcgttgcaacgggttgagctcgctcgactcgtagttcttttgactgcaaggacagcggtaccgtcgaacttaatgtgggccctagggcggttgaaccggaagctgctgggtggcgaaccgtcagcagggtggacagacgggcaggctgttgatcgcttggacagcccagaaccggcacgaccctggcactcggcaaagggagcacacaaacgaacaaggccatgcaggagtaagtaccgccggtctggtggtccggtggcgcaaccgaggccgccaaggcggaaggtgctgtccaccctgagtttccaaggacttagggcgggtgcacttgtgaggggctgcaaacattcgccatagatcttggcgccaaagatggccaaacggcggtccgggcatactgcagtaccgtgcggctctggcactcggcaaagtagctctttgccgagtgtctactgagtccctagaaaccaaacgtacgaattcggaagctcgacctaccagctggatgacactcggcacataaagtagcgcgtgcatctttgcacgacggagagtgtgggctggtgtcggacgaatacggacactcggcaaagaacctatatctcgtcggccgacctcgccacggaggagcgtcgacgagggcacgcgtgaggggcctgttcaggtgcgcggttgtggtgggagggcgctcaggcggagacccgctgtgtcgtaggaagttagcgcctggcactcggcaaagaaggtccgtctccgggttaagcttccgtgacaaccactacgatgagctcccgatggcatactggcgaagctgtgactgcgtcgagctccacctcgtcggcggcgaggagtccggcccaggcacggcactagccgatggcggggattcctgagattggtgcacggttctgccgagggatggcgctgaagcgcgcgacggctgcgttggtaatcgactggaatcgtctgcttctcgcagccgtggaccgagcgattccgaccgttgcaacgcatgagcactctccggtgaagtggtcgaggcggggggtgtttggtttctacggagcactcggcaaagaaagaaccgggccagcccggcacgatcgaccgtccagaagaaacagtcaccgagggaattcagcgaagggctctttgccgagtgtctaccagtcgaagtcagtgctggacctgagcaggttagcgcgagctttaccaacgacctccgggcagaagctcttcttcgacggatctgcaaggtccaggacctccacaggtgactgtggcagactggcttgccgcccctgccactgcgcatagggttaggggttcgggtactggccatagactatggcgccgagccgcgatacggctgatcggcgaaggcactcggcaaagatggggacactcggcaaagaaggaaaaggggacgctgctggagacagacccgacagcctgtttgggcgtgttttatttcgggcactcggttcgtcgtctgcggggtggagcaacggaggagggttgaggccctttgccgagtgccagatcagcgcctgagcggggagcaggagactattggagttgctctaagggtgacactcgacaaagaggttcggaccgtccgagtatgtcacagcctttgccgagtgtcatcggtgcccgtgcgttgcgacggcacgacggtcagtcggcgagctgtcgtctgggcagggcgtaacctctttgccgagtgccaaatagctctggatggtttgattgcattagccacgaaccaaacatatctgaccacgaatcaagcaaaccactcggcaaagaacctctttccacacctgcacaccacaagcccgctaacttcctacggcagactaccccgacgatggcgagtgggacggtcgagtgggatgttgaaggcctccagagcggtggaccgcgaagctaccgtgtgcccgccagcggggtgctggttggcgggacataagccttcggccgtccgtggtgcggtggatgcggagtttcctgggagcctggctgctgtcgcaacgcacgggcatgtaaggcaaaccagagacgctagccaaaggctttgccgagtgtaatccggtgaagtggtcgagggctgtgacactcgacaaagaagtcggaaagttgatgagcagacattagccacgaaccaaacataggccataggctgtggcgctaaacacagcctatggcgccgagcagagccacaaaaccggaggaggcctccggttttgtggctcccactctttgccgagtgccatattcagagacttggtcgtccgctcatcattggcgggtggctgagcggacgcaatcggacggtcgagccgtgccgtgcttgggccgggggcactaaaaagcacggccagcaatcccctccggttttatggcgcgtccgcggcgtgtggcgtaaagtcaaacgcttgatatgagagcttgactctagtccgcctgtggcggacccagaaattggcacccccccccccccccccaaaatcattggcgggtggctgggcgagtgggaagcagaccggtgcatagagaatgcacccaggccgactcgtgcgttgcaacgggaagagaagaaggctcaagcaaatcatgtgtctgggaagcggtgtcaatcccctccggtttttggagccatagatcttggcgcctactgtgacactcgacaaagagagttgctgggttgctcgacgggcgaatgagctttgcggggaggaagggtctgtttggttcgctacgccaagatctgtggcgccaagccacagatcttggcgccgagagcaccaagatctgtggcaccgtttttgacactcggcaaagtagagtgtccgtgcgttacagacagggctgatttggtgactcggacgggctggcccgacacagtcaaaaagcactcggcaaagagcgtgcttagtccggctgcacccactgacaggcgatgtgccgccgaccgcaactgctgctatcaccgtggtcgtgcgcgctttccgagggcccgttcggttgacaggggcggtcacgtcgaggtacgaggcagacagcaaggactgcgggaaccaaacaggcccatataccactcgatcctaggctggctgcttccgcaggagaggacaggagaaggttttgccgagtgtcaaagggctgatttggtgacaaggtatgggtccgcccctgcctgggagtgtccgtgcgttacaggcggcactcggcaaagaagcaaagtactctatgagccggcgatgcccacttgttgcgggcgcaggctggtctagaactgtttccggtgtgacactcgacaaagagtcgacactcggcaaagaagcaagtaggtggatgcccgtgcgttgaaccgaacaaggccttaaagaagcgtcagcatgttgcgtccgtccctccctccctccctccttttgctccggcacgaggacctaagtcctctcgtgcaaatcggcagcaggaggcagagcaggcagcgggcactcggcaaagaagttagtcatgaaccaaacaagccccgaagcccatgtgagaacgacaaacattttagtttgcagtcgttgctcggaggacctgttggtacacgcagtggcggagcacccgagccacaaaaccggagggaacctccggttttgtggctcacagctcaggaggtagccccggattcggctcgactcggctcgtgaggctgcgttggtaatcgaccgaggatctgtccgattgccccactggcactcggcaaagtctgtgactgagtgcagggcgaccggcgagttgtgatgtggtgagccttccaggagtgctccaggtcccgctcaggcggagacccgatggaatgaacccatgatgcaccaccaattccccgtggatcagcctggtcagctcggctcggatcagaggcgtcctcagcgacggacggttggactgtcgagtgggacgccgagtggctgctgtactagaagggctgatttggtgatccaagggactgcactgcgtaaacccgtctccgcttgggtcggctcgtgacgctagcgctgcaggccagggctgatttggtgaccggacctggtcctgacgtcccgactagagctgccaggagtaagtgcggcgcatggctgggcgttgggcgagactgcgagggctcaggtcgtgccgaggacggaaggccacgccataggctatggcgtcgacaccggacgcaccgattttcgtccgacccgttgcgatcgaggcccacttgttgcgggcgtaggctggtgcgggtgcctctcggagccaaacactcgacgaacgacgtcgcaacgcacgggcactcactggaccgcttgtcttccccacaactcagctagaggccctttacaaaccaaacaagcccttatcacagtgcggcacaaagctaatgggtcggaagcggggcaccggtgatgtcccaggcggttcgggggtgctgagccccgacatgccttttcgggcttgggccgggctcgtgatccattaccacctctcatgtgtctgggaagcggtgctggagtggaccgtgttgccggcaggcactcggcaaagaagccagccttctttgccgagtgcctccctacagcgcctcctacgtacgtggaccgagcgattctggcgaaccaaacaggccctatatgaggtgagtgcccgtgcgttgtggacggtcgagtgggatgctgctttgccgagtgccagatcggagccggctgcaaaccagaatggaacgacgacgagatcgagtctgatcagccgccgcccgctcccgagccctctttgccgagtgcaagggctgatttggtgatcggaaaaagcactcggcaaagaaacgagttgtgatgtggtgagcttggcccagagtagtcgcacgagaggttgtcgatgttccaggatgggcagcatccgacggacgaaggctggaggctagcaggacgcactatttcgctctccagcaggttcccgttgcaacgcacgggaggccatgagggactccctgtccggcccggtggcactatggccgttaggtgcaagcgtgtaagcgggcactcggcaaagagctcaggcgggggcagtctacaatacggtggttgcggtggcggcgggctgatcaggctgcgttggtaccctaatcaccaaatcagtccgtgacacagttagccacgaatcgaacgcagcggtaccctcgagaagttggctcgtccacgtcgtaggtgtacatttgggtcgggccgcgacctggttggcgatctgcgtgttgtggcccatgacccgagccacaaaaccggaggaaacctccggttttgtggctctaacaatcccctccggtttttggcccgtgccgtgcttgggccgatttggtgtaaccgaacaagcccgaaccaaacaggccctaggtaaaccttgtccgcgtgagcgaccaagatgcagttggtggacaacactcggcaaagaacctatactggcccaggcacggcacgcaagtgccgtgcctgggccagcaaagcactcggcaaagaaagtacggcgtcgtcgtcggatgctggagagtgactccacaaaccaaacgggccagcccggcacggatgactcggcaaagcctcggatttcgttggctctcggcaaagagggccatagactatggcgctgagcagtttcaacggtcgtctcgcgggggagcgacaactgccgtcgagcggggagcgtagggcaaatgcccgtgcgttgcaacaacaacggctgtctgcgctatgcgggagccacaaaaccggagcagagtaggtgcccgtgcgttgccaagtgtgacactcggcaaagaagtagcaacgcacgggcattcagtgctttgccgagtgtcaggggttttcttagtgggctgggccgtcgcaacgcacgggcacctaccgtgccacggacggtccagagactgagtgcagggcgaccttgggcggagtctgacgtaaggccgtggcgtcgacgtggcctcgggttgctgggataacttggtcgggggtgtttggtttctaaactgcgtgaccggccgagcgcggtaggcgaagtcgtgcgtgcatgtagcggttgcgtgcgcaggccatgggtaagccgatcctaggcggcgaagggtggggttagctgcacccaacaacctgcttcagctggttgtgggttgggccaggcgagtgtcggttgatctgagctggcccagagtagtcgcccgatcgtgtcggaccgtgctttgacagagcgaagctgaggcgagctcgtatctggtgagcctggctgacgacttcgtacggcgggcaggtgacgctcccgaagcggacaagggctgatttggtgactggcttcggctctgcgccatccttgctggccgtgggcttgacttgttctttgccgagtgccagcttgaggacaaagtgcgcactaaatggtacggcgtggcacaacgaaccacgtaccgaccaggtgcgttctttgccgagtgccatggttaggctctagggttcttgagagcctcgctgggttgctcggtgcaagatgcagttggtggatgaccaacggtgctgcgtcagggggactctcaacgaaagcagtttgacactcggcaaagaagcacgggtgacactcggcaaaggcgcgcttgcagcgattgagcctaggaaccaggttgcagggatggtcgagacttcggatggccgcgacggcggctttgccgagtgcttggcactcggcaaagaagctctgcctcgctgggttgctcaacgcgtaccgaccaggtgcgcagaaagctgaggcgtgctgcgtatgagcggggagcgtagggcaagcacccgttttgctgcgctctccggcggctttgccgagtgtccgacactcggcaaagaagtctcctcggcaaaggctcggattccgagccgagccgagctgacctcggaccaaggtccgatctaccatccggtgaagtggtcgacgacggggacgggtttggggagctagtcaaaacaggtggtggacttcaggagtaagtaccgcctgtccaacggtggcttccctaggaagggttgaccgacgaggacgtcgacgacgacgacgacgcgtcgccgctaacttcctacggccgcgactctcgggttgttctgggccaaccaaacgcaccctaagagaggcaggcaggcaggcatgtcccaagaggaggaccaggatcatggactttgtgtgcggtgtggggcctgtttggtttgtggctattgcaacgcacgggcactcataggcccattacagaggggtgagtggggccaacagggcgaatcggcactcggcaaagaaggctcctctttgccgagtgtctgctgtcttgcgcagccggagctccggcttgcagcgattgagcctgggggggtgtttggtttctaggaggcactcggcaaagaagttttgaggcctggacgcgaacggggaggcggttttgtcttagggttttctttgccgagtgccagatcctggtgcgggtgcctctcagtatcattggcgggtggctgagttgcctgggccggcccatcgtgcactcggcaaagaacctgacaagcagctgtcccaaacagggccgggcactcggcaaagattttcgagcactcggcaaagatcgtgtgtccgtgcgttgcgacggacgggcactcggcaaagagcttttagccacgaaccaaacaactcttcagacactcggtaaagaacatagacacagacggtcccacactgaccgaccatgaattcttctggctgtgactgcgcgctccttctttgccgagtgccaaaacccctaacaggggttgggtggtgaaggggagacttcgctcggctgtctttgccgagtgccgttccatcgggtagcgggtatgggggcagaggagcagcggagaagcacaacccctggaccgggaccacgagcactcggcaaagacccggccgaaccaaacaggccctagcaggcggaggccaagctggcgtggattgagtgagattgggtggagcaggctcgcgtgaggccgaggtctttgccgagtgccagaggagatggcgctaatgacgatccagaccgggctgatccacggagagtctccccgagccaccccatgaaccgagcgagccacgagcttcgcgggtatgggtttggggctgtcaggagtaagtaccacgccttgcctcgggcagagccagtcagcagggtggacaggcgggacgacgacgacgacgcgcgcaagatctatggcgccgaggtagacagcggcagcacgggggagggttctgtagcgctggactgacaagatctgtggcgccgagctctagctcggcgccacagatctcggtgggctcggccttcttattgcccgtgcgttgcaacagaagagggatgcggagtctgggaggacactcggcaaagaagtcttctggcactcggcaaagtctttctgcgcaccttccttcgtcggaggtctttgccgagtgctgaagtgacactcgacaaagagaatcaaccaaacgcaccctaaagaatggaccagcacgaggcacgggagcggggagcgtagggcatggtatctggctggccaggatgacgtctcgaccggagtctgctgctggtctagaactgtttccgactaataggccggcccaaatcatgggccgtgccagaaattgtgggcgtcgtcgtcggatgctttgaacaagctggccatcgtgaactctttgccgagtgccacacagcgtacaggagggtcgatggcaggcccattacagagggtgagggcgaagtcgtgcgtccagca

SEQ ID NO: 7958 - DNA, 21 bp, Zea mays
ttgctttcttcagatctccca

SEQ ID NO: 7959 - DNA, 21 bp, Zea mays
agggatggcaacgggtcggat

SEQ ID NO: 7960 - DNA, 21 bp, Zea mays
caaccgaacggggccttaggg

SEQ ID NO: 7961 - DNA, 21 bp, Zea mays
gtaggaagttagtcagctgac

SEQ ID NO: 7962 - DNA, 21 bp, Zea mays
cggagtgtggcgcggtgtggc

SEQ ID NO: 7963 - DNA, 21 bp, Zea mays
actaaagtggaataaaatgta

SEQ ID NO: 7964 - DNA, 21 bp, Zea mays
cccccatcactagcgggccgt

SEQ ID NO: 7965 - DNA, 21 bp, Zea mays
taatttagggactaaaatgaa

SEQ ID NO: 7966 - DNA, 21 bp, Zea mays
attatataagttggattatga

SEQ ID NO: 7967 - DNA, 21 bp, Zea mays
taaaatgagtggtgatgattt

SEQ ID NO: 7968 - DNA, 21 bp, Zea mays
atgtgcacatgagcaccgtac

SEQ ID NO: 7969 - DNA, 21 bp, Zea mays
gagggcgccgccgtcgtcatc

SEQ ID NO: 7970 - DNA, 21 bp, Zea mays
aaaatggaataaaatgaaggg

SEQ ID NO: 7971 - DNA, 21 bp, Zea mays
atagactaaagtggaataaaa

SEQ ID NO: 7972 - DNA, 21 bp, Zea mays
aagccgtcggacataaggctc

SEQ ID NO: 7973 - DNA, 21 bp, Zea mays
ttaataagtagtagagatata

SEQ ID NO: 7974 - DNA, 21 bp, Zea mays
taataagtagtagagatatat

SEQ ID NO: 7975 - DNA, 21 bp, Zea mays
atttttagtccatctatttta

SEQ ID NO: 7976 - DNA, 21 bp, Zea mays
aaaaaaaaagactgagtaatc

SEQ ID NO: 7977 - DNA, 21 bp, Zea mays
agggacacgctcgaaggctca

SEQ ID NO: 7978 - DNA, 21 bp, Zea mays
agcggatcagacagagtgcta

SEQ ID NO: 7979 - DNA, 21 bp, Zea mays
aacggaggggattggagaatc

SEQ ID NO: 7980 - DNA, 21 bp, Zea mays
gcctaaggttaggcagattgt

SEQ ID NO: 7981 - DNA, 21 bp, Zea mays
tagtccctagaaaccaaacac

SEQ ID NO: 7982 - DNA, 21 bp, Zea mays
attatataagttggattatgt

SEQ ID NO: 7983 - DNA, 21 bp, Zea mays
gatctaacggaccaagaggct

SEQ ID NO: 7984 - DNA, 21 bp, Zea mays
aacattcgatgtgataaggac

SEQ ID NO: 7985 - DNA, 21 bp, Zea mays
ggaaggcaccgcactgcgaga

SEQ ID NO: 7986 - DNA, 21 bp, Zea mays
gagagaattgtggagagttag

SEQ ID NO: 7987 - DNA, 21 bp, Zea mays
atggattggatgagattgagt

SEQ ID NO: 7988 - DNA, 21 bp, Zea mays
agagacgttagatctaagatg

SEQ ID NO: 7989 - DNA, 21 bp, Zea mays
actaaaatggaataaaatgta

SEQ ID NO: 7990 - DNA, 21 bp, Zea mays
aagggctgatttggtggtaag

SEQ ID NO: 7991 - DNA, 21 bp, Zea mays
acgccggagggggaggtggag

SEQ ID NO: 7992 - DNA, 21 bp, Zea mays
ccgacggctgtcagataagcc

SEQ ID NO: 7993 - DNA, 21 bp, Zea mays
atgtccgacggctgtcagata

SEQ ID NO: 7994 - DNA, 21 bp, Zea mays
ttgaactaagaaatagcagaa

SEQ ID NO: 7995 - DNA, 21 bp, Zea mays
tggattatggtggaagggtag

SEQ ID NO: 7996 - DNA, 21 bp, Zea mays
attatggtggaagggtaagag

SEQ ID NO: 7997 - DNA, 21 bp, Zea mays
ggagttcctaccgagttgcta

SEQ ID NO: 7998 - DNA, 21 bp, Zea mays
gggcttcttcttgcgcaggcc

SEQ ID NO: 7999 - DNA, 21 bp, Zea mays
tagtccctagaaaccaaacag

SEQ ID NO: 8000 - DNA, 21 bp, Zea mays
tcgtctaacctcaatctcatt

SEQ ID NO: 8001 - DNA, 21 bp, Zea mays
atttaagggaactgttgaatg

SEQ ID NO: 8002 - DNA, 21 bp, Zea mays
gattggaggggattgagtgaa

SEQ ID NO: 8003 - DNA, 21 bp, Zea mays
attggaggggattgagtgaaa

SEQ ID NO: 8004 - DNA, 21 bp, Zea mays
tgagcagtgcaatatataatt

SEQ ID NO: 8005 - DNA, 21 bp, Zea mays
agatctagatctaacggatca

SEQ ID NO: 8006 - DNA, 21 bp, Zea mays
actaaaatggaataaaatgga

SEQ ID NO: 8007 - DNA, 21 bp, Zea mays
attatataagttggattatgg

SEQ ID NO: 8008 - DNA, 21 bp, Zea mays
ggttccaagggactcggacaa

SEQ ID NO: 8009 - DNA, 21 bp, Zea mays
ggttcacaaaatgtaacgtaa

SEQ ID NO: 8010 - DNA, 21 bp, Zea mays
tgtgccagaagcggcgatggg

SEQ ID NO: 8011 - DNA, 21 bp, Zea mays
ggcgctcgtggccgccgtgct

SEQ ID NO: 8012 - DNA, 21 bp, Zea mays
aaccacaagatgcagttggtg

SEQ ID NO: 8013 - DNA, 21 bp, Zea mays
tgtgcaagcgtgcaagcaaat

SEQ ID NO: 8014 - DNA, 21 bp, Zea mays
taagggcttgttcggtttgag

SEQ ID NO: 8015 - DNA, 21 bp, Zea mays
agagacgttagatctaaaatg

SEQ ID NO: 8016 - DNA, 21 bp, Zea mays
agcagcagcaggcggcgccga

SEQ ID NO: 8017 - DNA, 21 bp, Zea mays
gtgcccgtggcgctggaggcc

SEQ ID NO: 8018 - DNA, 21 bp, Zea mays
agtgattcatcaaaccaaaca

SEQ ID NO: 8019 - DNA, 21 bp, Zea mays
aatacatgtggattgaggtca

SEQ ID NO: 8020 - DNA, 21 bp, Zea mays
ccactggcggttggtgtaaca

SEQ ID NO: 8021 - DNA, 21 bp, Zea mays
aatacatgtggattgagctca

SEQ ID NO: 8022 - DNA, 21 bp, Zea mays
caaccctaaaaaccgacggga

SEQ ID NO: 8023 - DNA, 21 bp, Zea mays
cggagaggattggaggggcta

SEQ ID NO: 8024 - DNA, 21 bp, Zea mays
ttgctggttcttgtgggtttt

SEQ ID NO: 8025 - DNA, 21 bp, Zea mays
aagctggattatggtggaagt

SEQ ID NO: 8026 - DNA, 21 bp, Zea mays
ccggggctggaggtggaggtg

SEQ ID NO: 8027 - DNA, 21 bp, Zea mays
tcggcgacgaggagcacctca

SEQ ID NO: 8028 - DNA, 21 bp, Zea mays
actaaagtggaataaaatgga

SEQ ID NO: 8029 - DNA, 21 bp, Zea mays
ggccagatgttcacgctgggg

SEQ ID NO: 8030 - DNA, 21 bp, Zea mays
aaatttagaggacgctgttaa

SEQ ID NO: 8031 - DNA, 21 bp, Zea mays
ccgtgagaagcgcagggaccg

SEQ ID NO: 8032 - DNA, 21 bp, Zea mays
actaaaatggaataaaatgaa

SEQ ID NO: 8033 - DNA, 21 bp, Zea mays
aggtgatggcaggacgacttt

SEQ ID NO: 8034 - DNA, 21 bp, Zea mays
caaggaggcagcggggcgaag

SEQ ID NO: 8035 - DNA, 21 bp, Zea mays
aggaccgaccaggcgcctaat

SEQ ID NO: 8036 - DNA, 21 bp, Zea mays
ttgttttttttttggcccatt

SEQ ID NO: 8037 - DNA, 21 bp, Zea mays
atgcacaaaacgaaatctggc

SEQ ID NO: 8038 - DNA, 21 bp, Zea mays
gtgtttggttggatgtacaag

SEQ ID NO: 8039 - DNA, 21 bp, Zea mays
actaaagtggaataaaatgca

SEQ ID NO: 8040 - DNA, 21 bp, Zea mays
ctgcacatgcagtgatgcctg

SEQ ID NO: 8041 - DNA, 21 bp, Zea mays
ggtctaaacgaacaagccctg

SEQ ID NO: 8042 - DNA, 21 bp, Zea mays
aacgattcggtggattataat

SEQ ID NO: 8043 - DNA, 21 bp, Zea mays
aaatcggagaagattagaggg

SEQ ID NO: 8044 - DNA, 21 bp, Zea mays
tatgacatgtggggccagtgg

SEQ ID NO: 8045 - DNA, 21 bp, Zea mays
gccgccggctgggtgctcgat

SEQ ID NO: 8046 - DNA, 21 bp, Zea mays
ccgagaggattggaggggatt

SEQ ID NO: 8047 - DNA, 21 bp, Zea mays
aggattggaggggattgaggg

SEQ ID NO: 8048 - DNA, 21 bp, Zea mays
aacattcgatgtgatagtgat

SEQ ID NO: 8049 - DNA, 21 bp, Zea mays
aacatcatgtggttcagatta

SEQ ID NO: 8050 - DNA, 21 bp, Zea mays
tttgcacggttgcacggaggg

SEQ ID NO: 8051 - DNA, 21 bp, Zea mays
cgtcataatttgatatcgtgt

SEQ ID NO: 8052 - DNA, 21 bp, Zea mays
tctggttttgctgtcgccgag

SEQ ID NO: 8053 - DNA, 21 bp, Zea mays
cagcggctgcaggagcggccc

SEQ ID NO: 8054 - DNA, 21 bp, Zea mays
attatggtggaagggtaggat

SEQ ID NO: 8055 - DNA, 21 bp, Zea mays
tgtgggcgaggagatatgcag

SEQ ID NO: 8056 - DNA, 21 bp, Zea mays
tggattatggtggaagggtga

SEQ ID NO: 8057 - DNA, 21 bp, Zea mays
ttttgtgcgagtcttgtatct

SEQ ID NO: 8058 - DNA, 21 bp, Zea mays
aactaaaaagaaacggagaga

SEQ ID NO: 8059 - DNA, 21 bp, Zea mays
gattggaggggattgaggtgg

SEQ ID NO: 8060 - DNA, 21 bp, Zea mays
attggaggggattgaggtgga

SEQ ID NO: 8061 - DNA, 21 bp, Zea mays
acggctcgacacggcttggat

SEQ ID NO: 8062 - DNA, 21 bp, Zea mays
atactaaaatggaacaaaatg

SEQ ID NO: 8063 - DNA, 21 bp, Zea mays
tctggatagtttgattgcaca

SEQ ID NO: 8064 - DNA, 21 bp, Zea mays
tggtgcaagcatgcaatcaat

SEQ ID NO: 8065 - DNA, 21 bp, Zea mays
gaaactggcagagtagcgaag

SEQ ID NO: 8066 - DNA, 21 bp, Zea mays
atgagtataaaatctgatggc

SEQ ID NO: 8067 - DNA, 21 bp, Zea mays
acaaatatctgaaccaaacgg

SEQ ID NO: 8068 - DNA, 21 bp, Zea mays
ggttaggctttaggtcgacgg

SEQ ID NO: 8069 - DNA, 21 bp, Zea mays
ttgccgagcgtcagacgttga

SEQ ID NO: 8070 - DNA, 21 bp, Zea mays
ggtgcatgcttctttgttacg

SEQ ID NO: 8071 - DNA, 21 bp, Zea mays
agacttgtgagtcattttcat

SEQ ID NO: 8072 - DNA, 21 bp, Zea mays
atgtgttaaggtggattagga

SEQ ID NO: 8073 - DNA, 21 bp, Zea mays
taatttagggactaaaatgga

SEQ ID NO: 8074 - DNA, 21 bp, Zea mays
cgctgctgctgctgctcctgt

SEQ ID NO: 8075 - DNA, 21 bp, Zea mays
gactaatcgcgattagtcgtc

SEQ ID NO: 8076 - DNA, 21 bp, Zea mays
accgccgtgatgatgtgcgcg

SEQ ID NO: 8077 - DNA, 21 bp, Zea mays
agggctagtttggaaactcaa

SEQ ID NO: 8078 - DNA, 21 bp, Zea mays
actaaagtggaataaaataaa

SEQ ID NO: 8079 - DNA, 21 bp, Zea mays
taatttagggactaaaataga

SEQ ID NO: 8080 - DNA, 21 bp, Zea mays
aactagagacgttagatataa

SEQ ID NO: 8081 - DNA, 21 bp, Zea mays
acagctacaggcactttcggc

SEQ ID NO: 8082 - DNA, 21 bp, Zea mays
attatataagttggattataa

SEQ ID NO: 8083 - DNA, 21 bp, Zea mays
aatggcgagcttgagacgttt

SEQ ID NO: 8084 - DNA, 21 bp, Zea mays
tttttgtgaggggctgcagca

SEQ ID NO: 8085 - DNA, 21 bp, Zea mays
ggggccgggcggtgggggcca

SEQ ID NO: 8086 - DNA, 21 bp, Zea mays
cggccacggccacggcgtcgg

SEQ ID NO: 8087 - DNA, 21 bp, Zea mays
ttggattttgattggatgcac

SEQ ID NO: 8088 - DNA, 21 bp, Zea mays
aatacatgtggattgaggtga

SEQ ID NO: 8089 - DNA, 21 bp, Zea mays
cagtgtatatgggtgactcgg

SEQ ID NO: 8090 - DNA, 21 bp, Zea mays
tttgtgaggggctgcaaagag

SEQ ID NO: 8091 - DNA, 21 bp, Zea mays
tgggcgttcccgaggaacgtc

SEQ ID NO: 8092 - DNA, 21 bp, Zea mays
acggttctactcggagggtct

SEQ ID NO: 8093 - DNA, 21 bp, Zea mays
ggagagcctaagcatctcaag

SEQ ID NO: 8094 - DNA, 21 bp, Zea mays
aactagagacgttagatctaa

SEQ ID NO: 8095 - DNA, 21 bp, Zea mays
ggttgaagagtagaatagagt

SEQ ID NO: 8096 - DNA, 21 bp, Zea mays
attggaggggattgaggggga

SEQ ID NO: 8097 - DNA, 21 bp, Zea mays
atggagtggattgagggggcc

SEQ ID NO: 8098 - DNA, 21 bp, Zea mays
gtggcaagagaattgaagaaa

SEQ ID NO: 8099 - DNA, 21 bp, Zea mays
agagacgttagatctaaaata

SEQ ID NO: 8100 - DNA, 21 bp, Zea mays
cggtccctggtgtgtgtggct

SEQ ID NO: 8101 - DNA, 21 bp, Zea mays
tggattatggtggaagggtaa

SEQ ID NO: 8102 - DNA, 21 bp, Zea mays
gtaggaagttagtcagctgat

SEQ ID NO: 8103 - DNA, 21 bp, Zea mays
ttcggcgcgagagaggagaat

SEQ ID NO: 8104 - DNA, 21 bp, Zea mays
tatataagttggattatataa

SEQ ID NO: 8105 - DNA, 21 bp, Zea mays
caagtaggctgatggggattg

SEQ ID NO: 8106 - DNA, 21 bp, Zea mays
ctagcagactgcttgcggctt

SEQ ID NO: 8107 - DNA, 21 bp, Zea mays
caggtgtaccccgagaccatc

SEQ ID NO: 8108 - DNA, 21 bp, Zea mays
gtgtgggtgtgggtgtggcgc

SEQ ID NO: 8109 - DNA, 21 bp, Zea mays
catcatcacctcattcctcat

SEQ ID NO: 8110 - DNA, 21 bp, Zea mays
aaggaatgaggtggtgatgga

SEQ ID NO: 8111 - DNA, 21 bp, Zea mays
gatctaacggaccaagaggcc

SEQ ID NO: 8112 - DNA, 21 bp, Zea mays
acccgggatcccgggaggatc

SEQ ID NO: 8113 - DNA, 21 bp, Zea mays
cccttgtcaccaaatcaacct

SEQ ID NO: 8114 - DNA, 21 bp, Zea mays
  unsure (19): n = A, C, G or T
gcttattttcggcggctancc

SEQ ID NO: 8115 - DNA, 21 bp, Zea mays
atccgacccgttgccatccct

SEQ ID NO: 8116 - DNA, 21 bp, Zea mays
ccctaaggccccgttcggttg

SEQ ID NO: 8117 - DNA, 21 bp, Zea mays
gtcagctgactaacttcctac

SEQ ID NO: 8118 - DNA, 21 bp, Zea mays
gccacaccgcgccacactccg

SEQ ID NO: 8119 - DNA, 21 bp, Zea mays
tacattttattccactttagt

SEQ ID NO: 8120 - DNA, 21 bp, Zea mays
acggcccgctagtgatggggg

SEQ ID NO: 8121 - DNA, 21 bp, Zea mays
ttcattttagtccctaaatta

SEQ ID NO: 8122 - DNA, 21 bp, Zea mays
tcataatccaacttatataat

SEQ ID NO: 8123 - DNA, 21 bp, Zea mays
aaatcatcaccactcatttta

SEQ ID NO: 8124 - DNA, 21 bp, Zea mays
gtacggtgctcatgtgcacat

SEQ ID NO: 8125 - DNA, 21 bp, Zea mays
gatgacgacggcggcgccctc

SEQ ID NO: 8126 - DNA, 21 bp, Zea mays
cccttcattttattccatttt

SEQ ID NO: 8127 - DNA, 21 bp, Zea mays
ttttattccactttagtctat

SEQ ID NO: 8128 - DNA, 21 bp, Zea mays
gagccttatgtccgacggctt

SEQ ID NO: 8129 - DNA, 21 bp, Zea mays
tatatctctactacttattaa

SEQ ID NO: 8130 - DNA, 21 bp, Zea mays
atatatctctactacttatta

SEQ ID NO: 8131 - DNA, 21 bp, Zea mays
taaaatagatggactaaaaat

SEQ ID NO: 8132 - DNA, 21 bp, Zea mays
gattactcagtcttttttttt

SEQ ID NO: 8133 - DNA, 21 bp, Zea mays
tgagccttcgagcgtgtccct

SEQ ID NO: 8134 - DNA, 21 bp, Zea mays
tagcactctgtctgatccgct

SEQ ID NO: 8135 - DNA, 21 bp, Zea mays
gattctccaatcccctccgtt

SEQ ID NO: 8136 - DNA, 21 bp, Zea mays
acaatctgcctaaccttaggc

SEQ ID NO: 8137 - DNA, 21 bp, Zea mays
gtgtttggtttctagggacta

SEQ ID NO: 8138 - DNA, 21 bp, Zea mays
acataatccaacttatataat

SEQ ID NO: 8139 - DNA, 21 bp, Zea mays
agcctcttggtccgttagatc

SEQ ID NO: 8140 - DNA, 21 bp, Zea mays
gtccttatcacatcgaatgtt

SEQ ID NO: 8141 - DNA, 21 bp, Zea mays
tctcgcagtgcggtgccttcc

SEQ ID NO: 8142 - DNA, 21 bp, Zea mays
ctaactctccacaattctctc

SEQ ID NO: 8143 - DNA, 21 bp, Zea mays
actcaatctcatccaatccat

SEQ ID NO: 8144 - DNA, 21 bp, Zea mays
catcttagatctaacgtctct

SEQ ID NO: 8145 - DNA, 21 bp, Zea mays
tacattttattccattttagt

SEQ ID NO: 8146 - DNA, 21 bp, Zea mays
cttaccaccaaatcagccctt

SEQ ID NO: 8147 - DNA, 21 bp, Zea mays
ctccacctccccctccggcgt

SEQ ID NO: 8148 - DNA, 21 bp, Zea mays
ggcttatctgacagccgtcgg

SEQ ID NO: 8149 - DNA, 21 bp, Zea mays
tatctgacagccgtcggacat

SEQ ID NO: 8150 - DNA, 21 bp, Zea mays
ttctgctatttcttagttcaa

SEQ ID NO: 8151 - DNA, 21 bp, Zea mays
ctacccttccaccataatcca

SEQ ID NO: 8152 - DNA, 21 bp, Zea mays
ctcttacccttccaccataat

SEQ ID NO: 8153 - DNA, 21 bp, Zea mays
tagcaactcggtaggaactcc

SEQ ID NO: 8154 - DNA, 21 bp, Zea mays
ggcctgcgcaagaagaagccc

SEQ ID NO: 8155 - DNA, 21 bp, Zea mays
ctgtttggtttctagggacta

SEQ ID NO: 8156 - DNA, 21 bp, Zea mays
aatgagattgaggttagacga

SEQ ID NO: 8157 - DNA, 21 bp, Zea mays
cattcaacagttcccttaaat

SEQ ID NO: 8158 - DNA, 21 bp, Zea mays
ttcactcaatcccctccaatc

SEQ ID NO: 8159 - DNA, 21 bp, Zea mays
tttcactcaatcccctccaat

SEQ ID NO: 8160 - DNA, 21 bp, Zea mays
aattatatattgcactgctca

SEQ ID NO: 8161 - DNA, 21 bp, Zea mays
tgatccgttagatctagatct

SEQ ID NO: 8162 - DNA, 21 bp, Zea mays
tccattttattccattttagt

SEQ ID NO: 8163 - DNA, 21 bp, Zea mays
ccataatccaacttatataat

SEQ ID NO: 8164 - DNA, 21 bp, Zea mays
ttgtccgagtcccttggaacc

SEQ ID NO: 8165 - DNA, 21 bp, Zea mays
ttacgttacattttgtgaacc

SEQ ID NO: 8166 - DNA, 21 bp, Zea mays
cccatcgccgcttctggcaca

SEQ ID NO: 8167 - DNA, 21 bp, Zea mays
agcacggcggccacgagcgcc

SEQ ID NO: 8168 - DNA, 21 bp, Zea mays
caccaactgcatcttgtggtt

SEQ ID NO: 8169 - DNA, 21 bp, Zea mays
atttgcttgcacgcttgcaca

SEQ ID NO: 8170 - DNA, 21 bp, Zea mays
ctcaaaccgaacaagccctta

SEQ ID NO: 8171 - DNA, 21 bp, Zea mays
cattttagatctaacgtctct

SEQ ID NO: 8172 - DNA, 21 bp, Zea mays
tcggcgccgcctgctgctgct

SEQ ID NO: 8173 - DNA, 21 bp, Zea mays
ggcctccagcgccacgggcac

SEQ ID NO: 8174 - DNA, 21 bp, Zea mays
tgtttggtttgatgaatcact

SEQ ID NO: 8175 - DNA, 21 bp, Zea mays
tgacctcaatccacatgtatt

SEQ ID NO: 8176 - DNA, 21 bp, Zea mays
tgttacaccaaccgccagtgg

SEQ ID NO: 8177 - DNA, 21 bp, Zea mays
tgagctcaatccacatgtatt

SEQ ID NO: 8178 - DNA, 21 bp, Zea mays
tcccgtcggtttttagggttg

SEQ ID NO: 8179 - DNA, 21 bp, Zea mays
tagcccctccaatcctctccg

SEQ ID NO: 8180 - DNA, 21 bp, Zea mays
aaaacccacaagaaccagcaa

SEQ ID NO: 8181 - DNA, 21 bp, Zea mays
acttccaccataatccagctt

SEQ ID NO: 8182 - DNA, 21 bp, Zea mays
cacctccacctccagccccgg

SEQ ID NO: 8183 - DNA, 21 bp, Zea mays
tgaggtgctcctcgtcgccga

SEQ ID NO: 8184 - DNA, 21 bp, Zea mays
tccattttattccactttagt

SEQ ID NO: 8185 - DNA, 21 bp, Zea mays
ccccagcgtgaacatctggcc

SEQ ID NO: 8186 - DNA, 21 bp, Zea mays
ttaacagcgtcctctaaattt

SEQ ID NO: 8187 - DNA, 21 bp, Zea mays
cggtccctgcgcttctcacgg

SEQ ID NO: 8188 - DNA, 21 bp, Zea mays
ttcattttattccattttagt

SEQ ID NO: 8189 - DNA, 21 bp, Zea mays
aaagtcgtcctgccatcacct

SEQ ID NO: 8190 - DNA, 21 bp, Zea mays
cttcgccccgctgcctccttg

SEQ ID NO: 8191 - DNA, 21 bp, Zea mays
attaggcgcctggtcggtcct

SEQ ID NO: 8192 - DNA, 21 bp, Zea mays
aatgggccaaaaaaaaaacaa

SEQ ID NO: 8193 - DNA, 21 bp, Zea mays
gccagatttcgttttgtgcat

SEQ ID NO: 8194 - DNA, 21 bp, Zea mays
cttgtacatccaaccaaacac

SEQ ID NO: 8195 - DNA, 21 bp, Zea mays
tgcattttattccactttagt

SEQ ID NO: 8196 - DNA, 21 bp, Zea mays
caggcatcactgcatgtgcag

SEQ ID NO: 8197 - DNA, 21 bp, Zea mays
cagggcttgttcgtttagacc

SEQ ID NO: 8198 - DNA, 21 bp, Zea mays
attataatccaccgaatcgtt

SEQ ID NO: 8199 - DNA, 21 bp, Zea mays
ccctctaatcttctccgattt

SEQ ID NO: 8200 - DNA, 21 bp, Zea mays
ccactggccccacatgtcata

SEQ ID NO: 8201 - DNA, 21 bp, Zea mays
atcgagcacccagccggcggc

SEQ ID NO: 8202 - DNA, 21 bp, Zea mays
aatcccctccaatcctctcgg

SEQ ID NO: 8203 - DNA, 21 bp, Zea mays
ccctcaatcccctccaatcct

SEQ ID NO: 8204 - DNA, 21 bp, Zea mays
atcactatcacatcgaatgtt

SEQ ID NO: 8205 - DNA, 21 bp, Zea mays
taatctgaaccacatgatgtt

SEQ ID NO: 8206 - DNA, 21 bp, Zea mays
ccctccgtgcaaccgtgcaaa

SEQ ID NO: 8207 - DNA, 21 bp, Zea mays
acacgatatcaaattatgacg

SEQ ID NO: 8208 - DNA, 21 bp, Zea mays
ctcggcgacagcaaaaccaga

SEQ ID NO: 8209 - DNA, 21 bp, Zea mays
gggccgctcctgcagccgctg

SEQ ID NO: 8210 - DNA, 21 bp, Zea mays
atcctacccttccaccataat

SEQ ID NO: 8211 - DNA, 21 bp, Zea mays
ctgcatatctcctcgcccaca

SEQ ID NO: 8212 - DNA, 21 bp, Zea mays
tcacccttccaccataatcca

SEQ ID NO: 8213 - DNA, 21 bp, Zea mays
agatacaagactcgcacaaaa

SEQ ID NO: 8214 - DNA, 21 bp, Zea mays
tctctccgtttctttttagtt

SEQ ID NO: 8215 - DNA, 21 bp, Zea mays
ccacctcaatcccctccaatc

SEQ ID NO: 8216 - DNA, 21 bp, Zea mays
tccacctcaatcccctccaat

SEQ ID NO: 8217 - DNA, 21 bp, Zea mays
atccaagccgtgtcgagccgt

SEQ ID NO: 8218 - DNA, 21 bp, Zea mays
cattttgttccattttagtat

SEQ ID NO: 8219 - DNA, 21 bp, Zea mays
tgtgcaatcaaactatccaga

SEQ ID NO: 8220 - DNA, 21 bp, Zea mays
attgattgcatgcttgcacca

SEQ ID NO: 8221 - DNA, 21 bp, Zea mays
cttcgctactctgccagtttc

SEQ ID NO: 8222 - DNA, 21 bp, Zea mays
gccatcagattttatactcat

SEQ ID NO: 8223 - DNA, 21 bp, Zea mays
ccgtttggttcagatatttgt

SEQ ID NO: 8224 - DNA, 21 bp, Zea mays
ccgtcgacctaaagcctaacc

SEQ ID NO: 8225 - DNA, 21 bp, Zea mays
tcaacgtctgacgctcggcaa

SEQ ID NO: 8226 - DNA, 21 bp, Zea mays
cgtaacaaagaagcatgcacc

SEQ ID NO: 8227 - DNA, 21 bp, Zea mays
atgaaaatgactcacaagtct

SEQ ID NO: 8228 - DNA, 21 bp, Zea mays
tcctaatccaccttaacacat

SEQ ID NO: 8229 - DNA, 21 bp, Zea mays
tccattttagtccctaaatta

SEQ ID NO: 8230 - DNA, 21 bp, Zea mays
acaggagcagcagcagcagcg

SEQ ID NO: 8231 - DNA, 21 bp, Zea mays
gacgactaatcgcgattagtc

SEQ ID NO: 8232 - DNA, 21 bp, Zea mays
cgcgcacatcatcacggcggt

SEQ ID NO: 8233 - DNA, 21 bp, Zea mays
ttgagtttccaaactagccct

SEQ ID NO: 8234 - DNA, 21 bp, Zea mays
tttattttattccactttagt

SEQ ID NO: 8235 - DNA, 21 bp, Zea mays
tctattttagtccctaaatta

SEQ ID NO: 8236 - DNA, 21 bp, Zea mays
ttatatctaacgtctctagtt

SEQ ID NO: 8237 - DNA, 21 bp, Zea mays
gccgaaagtgcctgtagctgt

SEQ ID NO: 8238 - DNA, 21 bp, Zea mays
ttataatccaacttatataat

SEQ ID NO: 8239 - DNA, 21 bp, Zea mays
aaacgtctcaagctcgccatt

SEQ ID NO: 8240 - DNA, 21 bp, Zea mays
tgctgcagcccctcacaaaaa

SEQ ID NO: 8241 - DNA, 21 bp, Zea mays
tggcccccaccgcccggcccc

SEQ ID NO: 8242 - DNA, 21 bp, Zea mays
ccgacgccgtggccgtggccg

SEQ ID NO: 8243 - DNA, 21 bp, Zea mays
gtgcatccaatcaaaatccaa

SEQ ID NO: 8244 - DNA, 21 bp, Zea mays
tcacctcaatccacatgtatt

SEQ ID NO: 8245 - DNA, 21 bp, Zea mays
ccgagtcacccatatacactg

SEQ ID NO: 8246 - DNA, 21 bp, Zea mays
ctctttgcagcccctcacaaa

SEQ ID NO: 8247 - DNA, 21 bp, Zea mays
gacgttcctcgggaacgccca

SEQ ID NO: 8248 - DNA, 21 bp, Zea mays
agaccctccgagtagaaccgt

SEQ ID NO: 8249 - DNA, 21 bp, Zea mays
cttgagatgcttaggctctcc

SEQ ID NO: 8250 - DNA, 21 bp, Zea mays
ttagatctaacgtctctagtt

SEQ ID NO: 8251 - DNA, 21 bp, Zea mays
actctattctactcttcaacc

SEQ ID NO: 8252 - DNA, 21 bp, Zea mays
tccccctcaatcccctccaat

SEQ ID NO: 8253 - DNA, 21 bp, Zea mays
ggccccctcaatccactccat

SEQ ID NO: 8254 - DNA, 21 bp, Zea mays
tttcttcaattctcttgccac

SEQ ID NO: 8255 - DNA, 21 bp, Zea mays
tattttagatctaacgtctct

SEQ ID NO: 8256 - DNA, 21 bp, Zea mays
agccacacacaccagggaccg

SEQ ID NO: 8257 - DNA, 21 bp, Zea mays
ttacccttccaccataatcca

SEQ ID NO: 8258 - DNA, 21 bp, Zea mays
atcagctgactaacttcctac

SEQ ID NO: 8259 - DNA, 21 bp, Zea mays
attctcctctctcgcgccgaa

SEQ ID NO: 8260 - DNA, 21 bp, Zea mays
ttatataatccaacttatata

SEQ ID NO: 8261 - DNA, 21 bp, Zea mays
caatccccatcagcctacttg

SEQ ID NO: 8262 - DNA, 21 bp, Zea mays
aagccgcaagcagtctgctag

SEQ ID NO: 8263 - DNA, 21 bp, Zea mays
gatggtctcggggtacacctg

SEQ ID NO: 8264 - DNA, 21 bp, Zea mays
gcgccacacccacacccacac

SEQ ID NO: 8265 - DNA, 21 bp, Zea mays
atgaggaatgaggtgatgatg

SEQ ID NO: 8266 - DNA, 21 bp, Zea mays
tccatcaccacctcattcctt

SEQ ID NO: 8267 - DNA, 21 bp, Zea mays
ggcctcttggtccgttagatc

SEQ ID NO: 8268 - DNA, 21 bp, Zea mays
gatcctcccgggatcccgggt

SEQ ID NO: 8269 - DNA, 21 bp, Zea mays
aggttgatttggtgacaaggg

SEQ ID NO: 8270 - DNA, 21 bp, Zea mays
  unsure (3): n = A, C, G or T
ggntagccgccgaaaataagc

SEQ ID NO: 8271 - DNA, 83 bp, Zea mays
ggaccgcactagggatggcaacgggtcggattcagatcggatattgaaaatatccgcccgcagtcatatccatggtcatagat

SEQ ID NO: 8272 - DNA, 181 bp, Zea mays
ccttcccaggcaaccgaacggggccttagggtgtgttcgtttattccggaatcgtgacctagaaccaatccaaccaggaatgcttatctaatttgtataggctttaatcacctggaaccattcctgccccaatcctgaacaaacgaacgcagccttagggcccgttcggttcttggggatt

SEQ ID NO: 8273 - DNA, 71 bp, Zea mays
gaagttagtcgtaggaagttagtcagctgacggcgctgacggcgtgaagctactaactttcgagaatctac

SEQ ID NO: 8274 - DNA, 95 bp, Zea mays
agcttacggcgccgcagcccgccacacctgcggcggccgatttgggcgccacacccgcggcagccggagtgtggcgcggtgtggcgcccgagcca

SEQ ID NO: 8275 - DNA, 125 bp, Zea mays
atttagtcccttcattttgttctattttagtatataaattgacaaatatagaaactaaaatagagttttagtttctacatttgataattttgtaactaaagtggaataaaatgtagggactaaaa

SEQ ID NO: 8276 - DNA, 227 bp, Zea mays
  unsure (94)..(95)..(96)..(97)..(98)..(99)..(100)..(101)..(102)..(103): n = A, C, G or T
gaaccctggccccccatcactagcgggccgtcaccgcccactctgcaacggcccagccggagggtggcgcgcaagacgtaacccgggagcggannnnnnnnnnactccatctggcagccttgctgagtgtgcagtggaagtcgagggtttccttggcctcagttgcctaggcgagctcaggcatccgtccgcataggtgtcgttggcgtagtggtggaaccccacga

SEQ ID NO: 8277 - DNA, 105 bp, Zea mays
tgcagtttattccattttagttcctaaattaccaaatacggaaaccaaaactctattttagtttttatatttagtaatttagggactaaaatgaaataaaatgaa

SEQ ID NO: 8278 - DNA, 211 bp, Zea mays
tcactcctatattatataagttggattatgatgtaaggatatggtgggtaaaatatcacattgggatctcaaataagctgaaatatgctacacaaataagctgaaataagctagcattgggtagcttattttagcttatttatgatcccaaagtggtattttacccctctcacccttccaccataatccaacttatataatctatgtggga

SEQ ID NO: 8279 - DNA, 178 bp, Zea mays
tgcacatattaaatcgccactattcatctcagatttaacgtctctggttgatcattgtaatttacaaataacactttccaccactacaacccaccacgtcagaagatgtctttaacaaatataccaaacaactacagacgttagatctaaaatgagtggtgatgatttaatatgtaca

SEQ ID NO: 8280 - DNA, 204 bp, Zea mays
gctcaaaggggtacgatgctcatgtgcacattttaaatctggtgcatccattttacatctaacagcygcaccaattttgtgaagcaccccttccaccttcctcccctggtgggagggttcttcgtaaaattagctggtgccgttgaatacaagatggatgcaccagatttaaaatgtgcacatgagcaccgtacccctttaagc

SEQ ID NO: 8281 - DNA, 250 bp, Zea mays
cctcggtctggagggcgccgccgtcgtcatctcctcccgcaagcaggtccagctgagctggaaaaccttatcgcttattttacccttcttgcttgctgtcctcgctttgggatttccattactgctctctctgattgggggtttctgtggatcgattggggttgcggggcgttgcagaagaacgtgaacgaggcggtggaggggctcagggccaagggtatcaccgcggttggtgccgtctgccacgtct

SEQ ID NO: 8282 - DNA, 102 bp, Zea mays
aatttttagtctcaccattttattgtattttactctttaaattgtcaaatataccgtataatttagagattaaaatggaataaaatgaagggacaaaaaatt

SEQ ID NO: 8283 - DNA, 119 bp, Zea mays
tagtccctctaatttattccactttagtcactaaattgtcaaatatggaaactaaaataaagttatagtttccatattttgcaatttatagactaaagtggaataaaatggagggacta

SEQ ID NO: 8284 - DNA, 103 bp, Zea mays
ggtccccgctaagccgtcggacataaggctctattatgtccgacgaccctcgctgggtcgtcggacataatagagtcttatgtccaacagcttagcgggggtt

SEQ ID NO: 8285 - DNA, 184 bp, Zea mays
ccttgcagtcttaataagtagtagagatatatgagagagaaggatatgcacggaagtcgaacaaatcaatgagataattctgcatcagttgatacagatttatctatcctatggtaacaatcagattataataatcgtaaaacattgtattctatgtcactgcacgccattgtagacatgcatc

SEQ ID NO: 8286 - DNA, 181 bp, Zea mays
cttgcagtcttaataagtagtagagatatatgagagagaaggatatgcacggaagtcgaacaaatcaatgagataattctgcatcagttgatacagatttatctatcctatggtaacaatcagattataataatcgtaaaacattgtattctatgtcactgcacgccattgtagacatgca

SEQ ID NO: 8287 - DNA, 149 bp, Zea mays
  unsure (78): n = A, C, G or T
ctatatactaatttttagtccatctattttattctattttagtctctaaattgtcaaatacgaaaagtaaaatagagntttagtttctgtatttagtaatttatggactaaaatagaataaaatagatgaactaaaaatcagttcataa

SEQ ID NO: 8288 - DNA, 170 bp, Zea mays
tgttacttagtattttgatttatttatatatttgtagaatttatttacattttagattcaatggaactagaaggataaccttcatgcgtggtcgcaacatctttagagggtgtcgggactgtccatgaactgcatatgaaaaaaaaaagactgagtaatcttcaaaattg

SEQ ID NO: 8289 - DNA, 90 bp, Zea mays
ttctttccacgactttctcgcgtgtacattagggtcattcagctcgacacggtccaccgagggacacgctcgaaggctcaccttgtaatc

SEQ ID NO: 8290 - DNA, 73 bp, Zea mays
taaattgacgagcctctaatggttcggcggatcacgtggttcagcggatcagacagagtgctacaccaataac

SEQ ID NO: 8291 - DNA, 89 bp, Zea mays
gagtccaaataacggaggggattggagaatctaaaattcttgaataaggaggggattttagcccctctaatccccttcggttttgtggc

SEQ ID NO: 8292 - DNA, 88 bp, Zea mays
ctgaagcgccacaacatgtctaacttttctgcctaagcttagttattcaatttgagcgcctaaggttaggcagattgtagcgccttag

SEQ ID NO: 8293 - DNA, 191 bp, Zea mays
catcaagggggtgtttggtttctagtgactaatatttagtccctacattttattctatttaagtcacaaaattgtcaaatatagaaactaaaactttattttagtttctatatttgacaatttatacactaaaatagaataaaatgatgggactaaacattagtccctagaaaccaaacacccaccaaatc

SEQ ID NO: 8294 - DNA, 171 bp, Zea mays
ttcctcctatattatataagttggattatgttgggagggtagaagagtaaaatatcactttggaattacaaataagctaaaataagtcatttgagcttatttgtggtcataatgtgatattttactctcctactcttccactataattcaatttatataatttagcaggaa

SEQ ID NO: 8295 - DNA, 171 bp, Zea mays
cgtgcaagcaaggtttttggttcgtttgattatgatccaatcatgtatctcatttaacatttaaactcttccaccaccggctcgagtagatttatagaaaaccccctaacataccacgttcatgtctacagttagatcatgatctaacggaccaagaggctcgtttgcacg

SEQ ID NO: 8296 - DNA, 189 bp, Zea mays
ctaaagtttagttcgtgacacatcaaatatttgaatatcaattataagtattaaatacatgcttgattaggtttaataaatttatcttatcttttagtcttcatctatgcaattagtcttataattaaactatatttaatatccataattatcattcaaacattcgatgtgataaggactaaactttag

SEQ ID NO: 8297 - DNA, 88 bp, Zea mays
acaacaatagcgcaggtgcggagcctggtcagcgggggtaggggacaggcgatgggaggaaggcaccgcactgcgagaggaacagatc

SEQ ID NO: 8298 - DNA, 175 bp, Zea mays
agattgagatgagagaattgtggagagttagttggcagcagataagtccaagaaagtaggagttagttgagagtttataggagaagttggttagccatagggctatttataagccacatggcatcagggaataaagcaagcaagattattatttcctaatctctctctctctcta

SEQ ID NO: 8299 - DNA, 200 bp, Zea mays
cttaattcgtatggattggatgagattgagtcaagatcttgttgttcattttaatctcaattcaggtaaattggatatgattgagtgaagatcttgttgttcattttaatctcaattcaagtggattgaacgggattaagtgagtttaaatcataattctttgtaatttcttcaaatctcatcagtccatatagaatgga

SEQ ID NO: 8300 - DNA, 151 bp, Zea mays
catcactatctattttagatttaacgtttctggttgatcattgcaatttataaataacaccttccaccactacaccccactacgtcggaggctatccttagcaaaatataccaaacaattagagacgttagatctaagatgagtgataatg

SEQ ID NO: 8301 - DNA, 125 bp, Zea mays
atttagtcccttcattttattctattttagtctataaattgctaaatatagaaactaaaataaagttttattttctatatttagtaattttggaactaaaatggaataaaatgtagggactaaaa

SEQ ID NO: 8302 - DNA, 150 bp, Zea mays
aaccagccctaagggctgatttggtggtaagggatcccaagaggatctatgtggagaaattcacttgcaattcaattttgaataaaaggggattcctccccatggatcaccttaggatctcttaccaccaaatcagccctgaatgagttg

SEQ ID NO: 8303 - DNA, 250 bp, Zea mays
gaagctgatcacgccggagggggaggtggagctgcaggtgcccgacgacgtctacatcctggacttcgccgaggaggaaggcatcgacctgcccttctcctgccgtgcggggtcctgctcctcctgcgccggcaaggtcgtctctggctccgtcgaccagtccgaccagagcttcctcaacgacaaccaggtcgccgacggttgggtgctcacctgcgctgcgtaccccacctccgacgtcgtcatcgag

SEQ ID NO: 8304 - DNA, 126 bp, Zea mays
taacttatgtccgacggctgtcagataagccatcgaacatagttttatgtccgacggctatcagtccggccgtcggacgtaagcttctgtccgacgtcttatctgacagccgtcagatataagtta

SEQ ID NO: 8305 - DNA, 134 bp, Zea mays
aaaataacttatgtccgacggctgtcagataagccatcgaacatagttttatgtccgacggctatcagtccggccgtcggacgtaagcttctgtccgacgtcttatctgacagccgtcagatataagttattat

SEQ ID NO: 8306 - DNA, 89 bp, Zea mays
gaccacagaattgaactaagaaatagcagaacaccagaaacagtagagccaatggctgttctccatttatttaatccaatttcacagac

SEQ ID NO: 8307 - DNA, 154 bp, Zea mays
ttatataagttggattatggtggaagggtaggagggtaaaatatcactttgagatcacaaataagctgaaataagctatccaatgctagcttatttatggtcccaaaatgatattttaccctcttacccttccaccataattcaacttatataa

SEQ ID NO: 8308 - DNA, 148 bp, Zea mays
tataagttgaattatggtggaagggtaagagggtaaaatatcattttgggaccataaataagctagcattggatagcttatttcagcttatttgtgatctcaaagtgatattttaccctcctacccttccaccataatccaacttata

SEQ ID NO: 8309 - DNA, 168 bp, Zea mays
ctgcatttagggagttcctaccgagttgctaaatgtggagagtaaatagagttgaatagcaactaagtaaatttagcaagtttatttagagaatcattggagaagcatttttctgttcacttcttaaatttaagatttagagacttgtttagagaactattggagttg

SEQ ID NO: 8310 - DNA, 93 bp, Zea mays; identical to SEQ ID NO: 5349

SEQ ID NO: 8311 - DNA, 190 bp, Zea mays; identical to SEQ ID NO: 5707

SEQ ID NO: 8312 - DNA, 164 bp, Zea mays; identical to SEQ ID NO: 5551

SEQ ID NO: 8313 - DNA, 201 bp, Zea mays
agttaggagtatttaagggaactgttgaatgcatgtttttatgtttttttcttaaaaaaacttgatttagagaagactttcaggaagctcttggagatgctctaccaccaacgaagagaatacctctttcaaatacattgataaatactcactgtcatgtcatcatcaaatatttctatagttcaattaaaaaacatttct

SEQ ID NO: 8314 - DNA, 76 bp, Zea mays
gctcacgggggattggaggggattgagtgaaaaataaactaattttcctcttaatatccttcaatcgccccgtgat

SEQ ID NO: 8315 - DNA, 74 bp, Zea mays
ctcacgggggattggaggggattgagtgaaaaataaactaattttcctcttaatatccttcaatcgccccgtga

SEQ ID NO: 8316 - DNA, 115 bp, Zea mays
aaagttgatctgagcagtgcaatatataattctggcatactattctcgcaatcgttttggggttcagaatgggactgacatcagagtaatatgtggcataccttctgatcctctg

SEQ ID NO: 8317 - DNA, 156 bp, Zea mays
gcagtcctcttggttcgttagatttagatccaaccgtatgtataatcgtggcttgttagaaactttttataaagctacacgaggtggtggtgtgatgatttaaatgttaagtatagcatacagttagatctagatctaacggatcaagagagctgc

SEQ ID NO: 8318 - DNA, 124 bp, Zea mays
ttatagtccctccattttatttcattgtagtcactaaatcattaaatacggaaactaaaactctattttagtttctgtatttagcaatttaggactaaaatggaataaaatggatggactaaaa

SEQ ID NO: 8319 - DNA, 185 bp, Zea mays
tcctttctaaattatataagttggattatggtagaaaggtagaaggataaaatatcactttagaaccataaataagctaaaataaactagcaatgagtagcttatttcagcttatttgtgatctaaagaggtattttactctcctgctattccactataatctaatttttataatttaagaggga

SEQ ID NO: 8320 - DNA, 253 bp, Zea mays
ggtgtttttgtgttggaacctttggaatcagatagaaaatggggaaatcctccaccggtagaaaatgggtctgctagcaacttgtccgcaccgcctcctaatggagcttcaagttctgatcaacctgaaagatgattgagaagatggaactggtagatttttcgtggcatgagtctaaccaagatgggcttcaaaaggtggtgcaactaaccttggcagatcggttccaagggactcggacaatgggctcaat

SEQ ID NO: 8321 - DNA, 186 bp, Zea mays; identical to SEQ ID NO: 5425

SEQ ID NO: 8322 - DNA, 204 bp, Zea mays
ggcggcggcggcgcccggctctgctcggacggactccaccgaaggctcggctcccctcggactccacctgcgacggccggccctctgcctgcaccgacggtgcccggctccctcggcatccaccagcggtgcccgactccaagaaatgtacaagtcacggctgcaggagctgtgccagaagcggcgatgggcgccgccgttgta

SEQ ID NO: 8323 - DNA, 110 bp, Zea mays
cggggaggctagccgggcggccggagctccaaccgcaatcggtctcttgctctgctgctgcgatggaggcgtcgtcgttggcgctcgtggccgccgtgctcctcctgtcc

SEQ ID NO: 8324 - DNA, 260 bp, Zea mays
agtaatcgtcgtccttccagtggtgttgatgtggtgcgctcgatgaagtatagatagctaatgctagcatattgttgttacggtgtcttacaatttaatgtttagttcgctactgtgcctttgtatatcttgtgctacttttgtgatactttcattatattcatacatatgcatctgcatctcatttaggaccgagagatgctgattgtgcaagtgatgaggtgccaaccacaagatgcagttggtggacgacctgaaga

SEQ ID NO: 8325 - DNA, 208 bp, Zea mays
acaatgtttctgtgcaagcgtgcaagcaaatcatctgatccattagattacgatccaaccacagatataaccatgttttgttaggggatttttttataaagattattgagctggtagtggaagagtttaaatgttaaatgtgacttacggttggatcacgatctaatgaatcaaatgttttgcttgcacgtttgcatagaaggactgc

SEQ ID NO: 8326 - DNA, 78 bp, Zea mays
ggtaaaccattaagggcttgttcggtttgaggtggatccctcaatccactcctaaccaaacaagccctaaagtaaacc

SEQ ID NO: 8327 - DNA, 150 bp, Zea mays
catcatcactcattttagatctaacgtctctagttgtttggtatattttgctaaggacaccctccaacgtggtgttgtgtagtggtggaaggtgttatttgtaaattgaatgatcaattagagacgttagatctaaaatgggtggtgatg

SEQ ID NO: 8328 - DNA, 120 bp, Zea mays
gcgaaggagtagcagcagcaggcggcgccgagtagcggctccccatctcgagcttgccaccatggtgagcgcttacacctctccgttcctccccgctgccttgcgcgcgcacgctttcgt

SEQ ID NO: 8329 - DNA, 190 bp, Zea mays
gacgggcctaggacctctcccgcgacggtgcctcgatgtcgcgcctgctggcccgcggcgacagcttggtggtctgctccgatggcaccacccgatagagagccatacctgctccgcttgagcccgctgttcgtggatctcggcggcaccggtggcgtcgtgcccgtggcgctggaggccgaggccgccc

SEQ ID NO: 8330 - DNA, 234 bp, Zea mays
tctaatgaagtgtttggtttgaggaatgatatagtccatcatcttctcactcctcacttttttgtttggtttgtagaatgaagtgagttaattcatcaccacctcattcctcatagttagttgttcagtactaatatttggaatagagtcatctcaccgaatttgaggaatggacccatgatgcaccacttcattttggatagagtgattcatcaaaccaaacacctcataaaa

SEQ ID NO: 8331 - DNA, 111 bp, Zea mays
actctagtatttacctcaattcccatgtgttgatgttgattggggtgtaaattagtttaagttacactctaatccacctcaatacatgtggattgaggtcaatactagagt

SEQ ID NO: 8332 - DNA, 164 bp, Zea mays
aaacatatttccactggcggttggtgtaacagaaccgccagtgaaaatagaatatttccactggcggttggtgtaacagaaccgccagtgaaaattagatttccactgtcggttctgttacacctggcggttgtgttatgataaccgccagtagaaatatgttt

SEQ ID NO: 8333 - DNA, 111 bp, Zea mays
actctagtattgaccctaatccacgtgtgttgaggtggattggggtgtaaattagtttaagttccaccccaatccacctcaatacatgtggattgagctcaatactagggt

SEQ ID NO: 8334 - DNA, 209 bp, Zea mays
ccataataattcccgtcggtttttagggttgccgacgggagttaattaactaccgtcggccataacgaagccgacgggagataaaataactcccgtcggtttttagggctgtcgacgggagttattttactaccgtcggcttcgttatggccgacggtagttaattaactcccgtcggcaaccctaaaaaccgacgggaattattatgg

SEQ ID NO: 8335 - DNA, 76 bp, Zea mays
gtccaaaaaccggagaggattggaggggctaaaatcaactttattttagcccctttaatctcctctgtttttgtga

SEQ ID NO: 8336 - DNA, 184 bp, Zea mays
tgtgaagagagacctgaaggagtggaatattgacaaagagctcgccgcagataggaaggggtggaagtgtgcaattcacgtgccagaaccctgattgatagtttcgcttttcctccttaatagtttgaccttttcttgtgctcattttagatcttgctggttcttgtgggttttatctctttta

SEQ ID NO: 8337 - DNA, 162 bp, Zea mays
tagattttataagctggattatggtggaagtgtaggaggataaaatatcacttggtgattataaataagctaaaataaactatccaatgttaacttatttatggtctaaaagggatattttacctgcatactctttcaccataatttaacttatataaacta

SEQ ID NO: 8338 - DNA, 79 bp, Zea mays
tacacgatcacgccggccgccgacagcgccagcacggccctgccgctgccggggctggaggtggaggtgggttggggag

SEQ ID NO: 8339 - DNA, 110 bp, Zea mays
aaggcggtgctcggcgacgaggagcacctcaaggcctttgaggaaacgctcgcctcgccctcctctcctccatgtcaagcccaggtgggcctcgtcgtcggcaagctcag

SEQ ID NO: 8340 - DNA, 125 bp, Zea mays
tactagtccctccattttatttcactttagttcataaattgctaaatacggaaactataactctattttagtttccgtatttaacaatttaggaactaaagtggaataaaatggagggactaaaa

SEQ ID NO: 8341 - DNA, 82 bp, Zea mays
gtcgcctgcgccgcggcgttcgcgtgggcgtccagagcgcgcaacaggatcggccagatgttcacgctggggtgcaacgcct

SEQ ID NO: 8342 - DNA, 89 bp, Zea mays
ctcttgagaagattccgtcttctactttctcgagcgggcgtattctaaactgtctcgtaaatttagaggacgctgttaaattttttata

SEQ ID NO: 8343 - DNA, 83 bp, Zea mays
tgcaccactgcgtctcgtgcgcgatccacgctcacatcgtccgcgtccgatcccgtgagaagcgcagggaccgcaagccgccg

SEQ ID NO: 8344 - DNA, 125 bp, Zea mays
ttttagtctctccattttattctattttagtgtctaaattatcaaatacggaaactaaaactctattttagttttcatatctagcaatttagggactaaaatggaataaaatgaagggacaaaaa

SEQ ID NO: 8345 - DNA, 115 bp, Zea mays
cttgatttaaagagacgtccctgccagccattgggcgagatgggcggcattgttgtagagctctgcacatgacagtctgcttgcaggtgatggcaggacgactttggacgcccag

SEQ ID NO: 8346 - DNA, 161 bp, Zea mays
actccagcgtcttcctccggcagccctccaagcacaaggggagcgagtgcgcagaagagccgcagcaagattgggcaggaaccaacaagacgaccagcggccgcccttgttgccaggctcccaaatgcgccaaggaggcagcggggcgaagagcggagggg

SEQ ID NO: 8347 - DNA, 79 bp, Zea mays
gtcgtgctataggaccgaccaggcgcctaatcgtgattagggtaacgattaggacgcctattcggtcctggtaagtgtg

SEQ ID NO: 8348 - DNA, 131 bp, Zea mays
tatttgattgttgttttttttttggcccattagataaaagtttattggaaaggacaacctttcacagcaatatgcatcctctgctgtagtattatttctcaggggccaagataaaagacaatgtctggaac

SEQ ID NO: 8349 - DNA, 187 bp, Zea mays
ccgtgcacaaatgcacaaaacgaaatctggccgtctattttccatccaacgacatgacggcgcgggggtttttcacaaaacagactcggtaagctacggaggctgcgggagggttcatctgcaaatttacgacggccgttggatgggagacggacgaccaggtttcgttttgtgcatttgtgcacgg

SEQ ID NO: 8350 - DNA, 188 bp, Zea mays
cacttatggtgtgtttggttggatgtacaaggagggatgaaagggagcgaccagtttttatagtgtttggatgagagtcacgtggtggcgagataaacatatagtggtgccgtgattccaaaaaatcgagagaactgtgtcgtcccgtctcatcctactttaatatcaaaccaaacacattaatttgt

SEQ ID NO: 8351 - DNA, 125 bp, Zea mays
gtttagtcccttcattttgttctattttagtatataaattgataaatatagaaactaaaatagagttttagtttctatatttaataattttgtaactaaagtggaataaaatgcagggactaaaa

SEQ ID NO: 8352 - DNA, 183 bp, Zea mays
cctacaacatctgcacatgcagtgatgcctgagttataatttaaacataatataagaagctgattataattatactcctacacatgataacaaaggttgtgcaaggttaagcaaatagcaggcacacatccttgctcgctatcctcgctcgacaaggcatcagtgcatcacagtgtcgggcaa

SEQ ID NO: 8353 - DNA, 77 bp, Zea mays
tggccatgtgagggcatgttcgcttagaccaatccagatggggattggtctaaacgaacaagccctgagggtgccat

SEQ ID NO: 8354 - DNA, 162 bp, Zea mays
acaagaatgcccctatatttgtactaggtcgaaccagacaagggcacctggagcctggcggctagggttaggaggagtcgaggaggaattatgctggatttgctggtcgctggatgccggatagacgcaaaaacgattcggtggattataatggcattggtg

SEQ ID NO: 8355 - DNA, 109 bp, Zea mays
gggagccataaaatcggagaagattagagggattagattctccttcttattcagttttgaataagaagagaatttaaccacttcaatttcttccggttttctggctctc

SEQ ID NO: 8356 - DNA, 75 bp, Zea mays
tctttgtgtgccactgagtgacatatatgtatattttgtgtgtgtatgacatgtggggccagtggcacacaagga

SEQ ID NO: 8357 - DNA, 257 bp, Zea mays
cggctacggcatcgaccccgcctgcgtcctccgccgccggacctacgccgacacacgcggccgcgtcacgccctacctcctctacctcgatcacgcccacgccgacatcgtcctcgcgctccgcgggctcaacctcgtcaaggagtccgactacgcgctccttctcgacaaccgtctcggcaagcgccgcttcgacggcggctacgtccacaacggcctcctcagggccgccggctgggtgctcgatgctgagtgcg

SEQ ID NO: 8358 - DNA, 90 bp, Zea mays
caaagggattccgagaggattggaggggattgaggggaaaataaactaatttcttcatcaatctccttcaatcatcctgggatctcgggt

SEQ ID NO: 8359 - DNA, 80 bp, Zea mays
ggattccgagaggattggaggggattgaggggaaaataaactaatttcttcatcaatctccttcaatcatcctgggatct

SEQ ID NO: 8360 - DNA, 189 bp, Zea mays
ctaaaatttagttcatgacgtatcaaatgtttgaatatcaattataagtattaaatataggcttaattagttttaataaattcgtctcatcttttaatctttgtctatgtgattagctttataatcagactatatttaatgctcataattatcattcaaacattcgatgtgatagtgattaaactttag

SEQ ID NO: 8361 - DNA, 165 bp, Zea mays
tgtaaacttctaatctgaaccatatgatgttgatccaaggggacgtgcggaggagtaggaggggatttgaaaaagtgtgattagcagcgggcggttaagtataaaattatccacgctcttgcgtcctttggatcaacatcatgtggttcagattataagtttgca

SEQ ID NO: 8362 - DNA, 216 bp, Zea mays
gcaaaccaactcctccgtgcaatcgtgcaaacttctaatctgggccacatgatgttgatccaagggacacaggggcgtgaataattttacacttaaccacccgctgctaatcacattttttcagatccccttcgcactcccccacacgccaccttagatcaacatcatgtggttcagattaaaagtttgcacggttgcacggaggggttggtttgc

SEQ ID NO: 8363 - DNA, 163 bp, Zea mays
catgttgatccgtcataatttgatatcgtgtatatatatgtatagctgatagttaatatagttaagttatataagagatgtataaatctgtatgcgtatactataggtgtagcatatgcatgcatgatagaagcacgaaggttaaatgctgacgaatcacgtg

SEQ ID NO: 8364 - DNA, 162 bp, Zea mays
ctgcccaggaggcgtacgaggaggacgacgagatgccgggcggagcccagagagtgcagtgcgcgcaacagtaagcagactatcatcaaggcaattgggaggggtggtgcccttaaagcatgggagtgatctctggttttgctgtcgccgagctgggaaata

SEQ ID NO: 8365 - DNA, 144 bp, Zea mays
cccgcggcatgggcgcgcccgagccgccgcgcacctaccacatcaacctgtccgtgttcacctccctgccggacatgtgggccatcgggcagcagttccccatcatcccgatccagcggctgcaggagcggcccgccgtcgacg

SEQ ID NO: 8366 - DNA, 156 bp, Zea mays
cgtaagttagattatggtggaagggtaggatggtaaatatgactttgagattacaaataaggtgaaataagctacccaatgttagcttatttcagtttatctgtagtcccaaagtgatatttaccctactatccttccaacataatccaacttata

SEQ ID NO: 8367 - DNA, 179 bp, Zea mays
  unsure (132)..(133)..(134)..(135)..(136)..(137)..(138)..(139)..(140)..(141): n = A, C, G or T
cattacgatctgtgggcgaggagatatgcagccagtctacaaccatcttctggcctgagccctgtccctgcataataggtcgtcacgacaacgttgtacagcaggagttctaagatatgatgtgtttgggcnnnnnnnnnnaggtttgtggctcctgtttccatgttcaattttcaggc

SEQ ID NO: 8368 - DNA, 189 bp, Zea mays
ttatataagttggattatggtggaagggtgagaggggtaaaataccactttgggatcataaataagctaaaataagctacccaatgctagcttatttcagcttatttgtgtagcatatttcagcttatttgagatcccaatgtgatattttaccccacatatccttacatcataatccaacttatataa

SEQ ID NO: 8369 - DNA, 232 bp, Zea mays
gttttggatcttttgtgcgagtcttgtatctcgtgtacgttgcattgcattgttgtgttatgcttctgctggcttgtaccgccttgttatgtgacatctggtgtgtgtggattctgggaatccaaagaaagctcgggagctgcagcgggcgctgcgcggcatggaatgatttgccaaattgaaatcacgacaacatgcctacgatgcaaactgggcataagagacagacgag

SEQ ID NO: 8370 - DNA, 97 bp, Zea mays
taaaacatatttcctccgtttcgttttagtagtcgttggatagtataaaattaattatccagcgataactaaaaagaaacggagagagtaataaata

SEQ ID NO: 8371 - DNA, 77 bp, Zea mays
atcctcttcggattggaggggattgaggtggaaataaactaatttcctcttcaatccccttcaatcccgaaggagat

SEQ ID NO: 8372 - DNA, 74 bp, Zea mays
tcctcttcggattggaggggattgaggtggaaataaactaatttcctcttcaatccccttcaatcccgaaggag

SEQ ID NO: 8373 - DNA, 91 bp, Zea mays
  unsure (41)..(42): n = A, C, G or T
tcagaatagcacggctcgacacggcttggatcggtccgatnncgaaaatttagatctgacctaactctgtatttagaccatgctattttga

SEQ ID NO: 8374 - DNA, 84 bp, Zea mays
gtcaatttatatactaaaatggaacaaaatgaagggactaaatattagtcccttcattttgttcaattttagtacttaaattgt

SEQ ID NO: 8375 - DNA, 180 bp, Zea mays
ggtgcaagcatgcaatcaatcaatccggtgtatccaatctagatccaatgatgaatgttactttacaggtaaccccttccacttgaaacctagtacctattttacttttaaccccttccatatgaaaccattgaatctagattagatgttctggatagtttgattgcacacttgcaccaa

SEQ ID NO: 8376 - DNA, 200 bp, Zea mays
tcatttatattggtgcaagcatgcaatcaatcaatccggtgtatccaatctagatccaatgatgaatgttactttacaggtaaccccttccacttgaaacctagtacctattttacttttaaccccttccatatgaaaccattgaatctagattagatgttctggatagtttgattgcacacttgcaccaaatgagtgat

SEQ ID NO: 8377 - DNA, 163 bp, Zea mays
taggcaccaacttcgttcgtgtacagttaacaacgttaagagccaagggtataattgtcagttaaagtgtaagagttaacgtccaggtcagtgaagaagtacaaatggcattatatctgtgaaccgttgtttgaaactggcagagtagcgaagcacattgccc

SEQ ID NO: 8378 - DNA, 138 bp, Zea mays
ttccctgtatgccatcggaaaatatactagttacttgtgtgccactggtcccatatgtcatacacacaaaaaaatatatctatatgccactcagtggcacacaaggaatgagtataaaatctgatggcataccagaaa

SEQ ID NO: 8379 - DNA, 128 bp, Zea mays
  unsure (7): n = A, C, G or T
aatttangtgctgtttggttcaataaatgtaacgcaaagggtaatggtaagggactaaaacaaacatgatttaatattatcgtttacccattacgttacaaatatctgaaccaaacggtaccttagtt

SEQ ID NO: 8380 - DNA, 88 bp, Zea mays
ttacgtggcaggttaggctttaggtcgacggtgagctggacagccgcaatggcgccatcgtcggacgtggtgcccaacacggcccggg

SEQ ID NO: 8381 - DNA, 89 bp, Zea mays
acactcgacggacggcgatgctcggcaaaggatcgtgtatagcttacgaccattatctttgccgagcgtcagacgttgaatcgaattgc

SEQ ID NO: 8382 - DNA, 206 bp, Zea mays
ctcttcgtctcagtaatagtgacagcattcaccctccaggtacacacacacactacatactctccattctcatcactgatgaacattcaagctaataatcacttcgcggcctttgcaggatggttcgtcacactacctcaaggggatccttctgctgctgtgctacattgtgatcggtgcatgcttctttgttacgaggcaacctg

SEQ ID NO: 8383 - DNA, 249 bp, Zea mays
gtgtgtgtgtgtgacatgctcatatatcttccatgatcaaggtaatgatcggcgttgagtgtgttgctcaaccgccattatacaatatgcaattattattagataattatcaacgagattcctgaattatatttttggatggagggagtagtatttaaagaagagccttgcatgcaatttctttttgtttgaataatgttttcaacttaaattcgatcagacttgtgagtcattttcataaaccaacac

SEQ ID NO: 8384 - DNA, 73 bp, Zea mays; identical to SEQ ID NO: 5757

SEQ ID NO: 8385 - DNA, 105 bp, Zea mays
tctactttattctattttaattcataaattgttaaataagaaaattaaaatggagttttagtttctatatttagtaatttagggactaaaatggaataaaattga

SEQ ID NO: 8386 - DNA, 73 bp, Zea mays
  unsure (1): n = A, C, G or T
ngggaggctgcgctgctgctgctgctcctgtgcgcggcggcgttcgtggagcgcggcgcggcgctgcacctct

SEQ ID NO: 8387 - DNA, 140 bp, Zea mays
taaagtcgttcgactaatcgtgattagtcggccttatcgctggagcaagctcgaccagggtcttcgactcgactagggtgactaggaagcgattagtctcctagtcgccgactaatcgcgattagtcgtccgactagtgt

SEQ ID NO: 8388 - DNA, 119 bp, Zea mays
ggcggagaaggccagcagcaccacggggccgatcacccaccccagctgcgcgatcgcccacgccagcgacagcacgcccgacccgatcaccgccgtgatgatgtgcgcgctcgccgtca

SEQ ID NO: 8389 - DNA, 141 bp, Zea mays
aatatacattagggctagtttggaaactcaaatccccttcggtattgaagggaattggagaacaaattagtttatttctacctcaatccccaccaatctcgaagagaatttgaggttcccaaagtagcccttatggacgag

SEQ ID NO: 8390 - DNA, 125 bp, Zea mays
ttttagtccctatattttattccactttagtctataaattgccaaatacggaaactataactacattttagtttccatatttagcaatttatgaactaaagtggaataaaataaagggactaaaa

SEQ ID NO: 8391 - DNA, 80 bp, Zea mays
tccatcttatttgattttagtctataaattattaaatacgagaattttgtaatttagggactaaaatagaataaaatgga

SEQ ID NO: 8392 - DNA, 143 bp, Zea mays
agcattcatcttatatctaacgtatgtagttgtttggtatattttactaatcacaccctccaacgtggtggagtgtagtggtggaatgtgttatttataaattgcaataatcaactagagacgttagatataagatgagtggt

SEQ ID NO: 8393 - DNA, 234 bp, Zea mays
tatcacaacaacagctacaggcactttcggcggccattgttattttcggcggcctatacccggccgccgaaaataacctggtatttccggcggcttctcgaagccgccgaaaataaggttattttcggcggcttcgagaagccgccggaaataccaggttattttcggcggccgggtataggccgccgaaaataacaatggccgccgaaagtgcctgtagctgttgttgtgata

SEQ ID NO: 8394 - DNA, 159 bp, Zea mays
acccctctagattatataagttggattataatagaagagtaatatgttaaaatatcattttggtatcacaaataagctgctagcttatttgttgtaccaaagtgatattttatcttcctactcttctactataatctaacttatataatttagaagtaa

SEQ ID NO: 8395 - DNA, 239 bp, Zea mays
ccggtgaggtgaacgtccgtgttccccacgtgagtggccaggtcctcgtgccacgtcatcgtcgccgccgccgtcgtcttgccgccgcggcgccgatcgcttttgctccgcgtgtacgtgctcccagtcccaagagagaggtttggaaattgggaggcgaagaagggaggagtggaagaccggcactgggagttggaaacggaggcgaaatggcgagcttgagacgtttggctgacttg

SEQ ID NO: 8396 - DNA, 141 bp, Zea mays
gaaacaaatttgttgcagctcctcacaaaaaaggaggataaactttacctgcatgtctactagataacgttttagttgtattattggtctacagatgaagcatatcctcttttttgtgaggggctgcagcaaatttttttc

SEQ ID NO: 8397 - DNA, 159 bp, Zea mays
aacgaaaatgtggcgaccgcccgctcggcgggcgcgcggcgagagagctcaccggagtcgggcggatctcttgggcaggaagcccaggacagcggtgcagcgtggggaaggggcgctcgccgacgagcggggccgggcggtgggggccaccgtcagtgg

SEQ ID NO: 8398 - DNA, 177 bp, Zea mays
gcgccttcgccggccacggccacggcgtcggcatggtcccggccggcccgatgggcatgcagcacaacgcggctcctcccatgatgtacccggcgccgccgcccggcgctgtatacccggtgatgggcgacggcatggggtaccacggcggcgccgggggcgtggcggtggtgccgc

SEQ ID NO: 8399 - DNA, 114 bp, Zea mays
aagtgatgtggtgcatctaatcaaaattcaacggtggcacatattttaggtagaaggggttaaatataaaatagcagttaccattggattttgattggatgcaccagattcatt

SEQ ID NO: 8400 - DNA, 79 bp, Zea mays
actctagtattcattccaatccacatgtaatgatgtggattgagacgtaatacatgtggattgaggtgaatactatatt

SEQ ID NO: 8401 - DNA, 93 bp, Zea mays
tttgacccgatgggtgacccatacccacatgagtatgggtatgggggtaaattcatacccaccagtgtatatgggtgactcggtggggttatt

SEQ ID NO: 8402 - DNA, 146 bp, Zea mays
tcaaaccagactgtttacagcccctcacaaaaagaaatatagaccccacctgcaggtccatcggataacgttttagttgagttattgctgctgcgggtggggtctatcttccttttttgtgaggggctgcaaagagtctggtttac

SEQ ID NO: 8403 - DNA, 148 bp, Zea mays
gttgcgccctgcacgttcttcgggacgccgtttccacaggagggccagaagaaggcgcctcgggtcatgctggtgttcttctgcatcccggtcggtcctggcaggagcagggtgatctgggcgttcccgaggaacgtcggggtctggc

SEQ ID NO: 8404 - DNA, 89 bp, Zea mays
tggtggcggcgacgctccggtgggtgctgcagctgcaccgggacgtaccgcgggcagcacggttctactcggagggtctcgacttcagt

SEQ ID NO: 8405 - DNA, 201 bp, Zea mays
taacctttttggagagcctaagcatctcaagtttgaccaaaattatagagagagttaacaaccttatgaaataaagctggtattactatgataatacaattaataaagaatctaacaatacttaattggtaccatgaatattataattttattatataactttggttaaacttgagatgctctggctctttaaaaagttga

SEQ ID NO: 8406 - DNA, 144 bp, Zea mays
caccattcattttagatttaacgtctctagttgtttggtacattttactaaagacacccttcaacgtggtggtgtgtagtggtggaaggtgttatttgtaaattgaataatcaactagagacgttagatctaaaatgagtgatg

SEQ ID NO: 8407 - DNA, 259 bp, Zea mays
ttttttgtttggttgaagagtagaatagagtggagtcactctgttttttgtttggttggagagtcatatgagtatagaggagaggagagcgctcgcatctggtcgtttttgtggagcggaagcattctaattatttatagtaaatttctatatagagactccagtaaccgtttcgctcttattttttttgaaaaccaaacatccaaataataagaacggagccacttcattctcattcactcctcaaccaaacacatcc

SEQ ID NO: 8408 - DNA, 74 bp, Zea mays
tcacaggaggattggaggggattgagggggaaattagtttatttccctctcgaccccttccaatcctcccgtga

SEQ ID NO: 8409 - DNA, 120 bp, Zea mays
gggatttacaccctctccaatccctccaaaacactctaatatcaaagtattcaaactaggccttaaggggttgtttggaaacaagagtaatggagtggattgagggggccaaaattcctt

SEQ ID NO: 8410 - DNA, 136 bp, Zea mays; identical to SEQ ID NO: 5720

SEQ ID NO: 8411 - DNA, 150 bp, Zea mays
atcaatatccattttagatctaacgtttctagttaatcatggcaatttacaaatacccccttccaccactacacaccaccacgtcggatgatgttcttagcaaaatatatcaaataattagagacgttagatctaaaataagtgatgatg

SEQ ID NO: 8412 - DNA, 174 bp, Zea mays
ggggaatgttactacaccaccatctactgatctataaccaggggaaacattgaagtcaggcgtggtggagaagcgggttggtcgcaagcgccaagctaatgttcgtatctctagacctgagtgggtgtaatgtctctgtgtggcggtccctggtgtgtgtggctgacaggcagg

SEQ ID NO: 8413 - DNA, 163 bp, Zea mays
ttatatatgttggattatggtggaagggtaatagggtaaaaatcactttaggactgcaaataagctaaaataatctaacattgggtagtttatttcagcttatttgtgatcttaaagttgtattttaccctattactctttcaccataatccaacttatataa

SEQ ID NO: 8414 - DNA, 71 bp, Zea mays
gaaattagtcgtaggaagttagtcagctgatggcgctgatgacgtgaagctactaacttctgagaacctac

SEQ ID NO: 8415 - DNA, 147 bp, Zea mays
ctcggcgatcttcggcgcgagagaggagaatccctgctggaacccttccgccgacagaacctcgcagcttatggaagggcgcagggcagcgattagcgtcgagcaggtctcctcctgcctctccttcttgtgcagcagctccatgcc

SEQ ID NO: 8416 - DNA, 221 bp, Zea mays
tttatatagattatataatgtagtttatataatcttatttggtgggtaaatattcaccaagttttaaggtcacagggtaaaaaataatctaaataaacacataatgtcatacttatatattattatattctgggtacctagattatataattcatcccaataatttgtgtcgtttgtttgtctcttaacttatataagttggattatataatctatatggt

SEQ ID NO: 8417 - DNA, 155 bp, Zea mays
ggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgca

SEQ ID NO: 8418 - DNA, 96 bp, Zea mays
aaagcaaagagagccgaaagcggctgctagctagtggcagcaaccagcaggcagacaggtcatagctagcagactgcttgcggcttggcttaccgc

SEQ ID NO: 8419 - DNA, 150 bp, Zea mays
ccttggcgtcagagtccggggtgtactgtcgcagcgtgaggacgccctgtatgttgctggagttggaggcggcgccagcagcatcgatggcggcggtggcgagccagtcggtcgcgatccaggtgtaccccgagaccatcatgccgagcc

SEQ ID NO: 8420 - DNA, 244 bp, Zea mays
gcgtgtacttggaccccatctccgccggcgccgcgcctcctcctagagcattcgccgggaagccgcctcctraggtgttccgctgcgtttcggaggcctcccggtggccgctgcctgcgttccggcagctcggctcggctctgcgctcgccgcgcgggcggatggcgggatggggctcgtgggctggctggccggccggggttggttggtgcggtgtgggtgtgggtgtggcgcagtcggggtg

SEQ ID NO: 8421 - DNA, 231 bp, Zea mays
taggatgatgcatcatcacctcattcctcataagtcaatgattagtactaatatgaggaatgaagtcaatttactaaggtggtgtttggtttgaggaatcacttcatccaaaatgaggtagacaggtggtgcatcataagtctattcctcagatttggtagaatgaccccattcctcatgttagtactaactaacaaactataaggaatgaggtggtgatggatcaactca

SEQ ID NO: 8422 - DNA, 235 bp, Zea mays
aataggatgatgcatcatcacctcattcctcataagtcaatgattagtactaatatgaggaatgaagtcaatttactaaggtggtgtttggtttgaggaatcacttcatccaaaatgaggtagacaggtggtgcatcataagtctattcctcagatttggtagaatgaccccattcctcatgttagtactaactaacaaactataaggaatgaggtggtgatggatcaactcatt

SEQ ID NO: 8423 - DNA, 172 bp, Zea mays
cgtacaagtaggtcttttggtccgctagatttagatctaaccgtagatgcgatcatggtttgttaggagctttttttataaagctccacgaggtggtggtggaagggtttaaatgctaaatatgacatacggttggatctagatctaacggaccaagaggcctgcttgcacg

SEQ ID NO: 8424 - DNA, 111 bp, Zea mays
tgatttagtgacccgggatcccgggaggatcggaggggattgagggggaaattagttcatttccctcttaatcccatccaatcctcctgggatccccttgtcaccaaatca

SEQ ID NO: 8425 - DNA, 137 bp, Zea mays
catatttagagttgatttagtgacccgggatcccgggaggatcggaggggattgagggggaaattagttcatttccctcttaatcccatccaatcctcctgggatccccttgtcaccaaatcaaccttagtctctta

SEQ ID NO: 8426 - DNA, 102 bp, Zea mays
  unsure (90)..(90): n = A, C, G or T
tggcggcgagggttggccgccgaaaataatgttatttccggcagcttctgacacagccgccaaatttaacagcttattttcggcggctanccctggccaccg

SEQ ID NO: 8427 - DNA, 3276 bp, Zea mays
  unsure (3274)..(3274): n = A, C, G or T
agggatggcaacgggtcggatcaaccgaacggggccttaggggtaggaagttagtcagctgaccggagtgtggcgcggtgtggcactaaagtggaataaaatgtacccccatcactagcgggccgttaatttagggactaaaatgaaattatataagttggattatgataaaatgagtggtgatgatttatgtgcacatgagcaccgtacgagggcgccgccgtcgtcatcaaaatggaataaaatgaagggatagactaaagtggaataaaaaagccgtcggacataaggctcttaataagtagtagagatatataataagtagtagagatatatatttttagtccatctattttaaaaaaaaaagactgagtaatcagggacacgctcgaaggctcaagcggatcagacagagtgctaaacggaggggattggagaatcgcctaaggttaggcagattgttagtccctagaaaccaaacacattatataagttggattatgtgatctaacggaccaagaggctaacattcgatgtgataaggacggaaggcaccgcactgcgagagagagaattgtggagagttagatggattggatgagattgagtagagacgttagatctaagatgactaaaatggaataaaatgtaaagggctgatttggtggtaagacgccggagggggaggtggagccgacggctgtcagataagccatgtccgacggctgtcagatattgaactaagaaatagcagaatggattatggtggaagggtagattatggtggaagggtaagagggagttcctaccgagttgctagggcttcttcttgcgcaggcctagtccctagaaaccaaacagtcgtctaacctcaatctcattatttaagggaactgttgaatggattggaggggattgagtgaaattggaggggattgagtgaaatgagcagtgcaatatataattagatctagatctaacggatcaactaaaatggaataaaatggaattatataagttggattatggggttccaagggactcggacaaggttcacaaaatgtaacgtaatgtgccagaagcggcgatgggggcgctcgtggccgccgtgctaaccacaagatgcagttggtgtgtgcaagcgtgcaagcaaattaagggcttgttcggtttgagagagacgttagatctaaaatgagcagcagcaggcggcgccgagtgcccgtggcgctggaggccagtgattcatcaaaccaaacaaatacatgtggattgaggtcaccactggcggttggtgtaacaaatacatgtggattgagctcacaaccctaaaaaccgacgggacggagaggattggaggggctattgctggttcttgtgggttttaagctggattatggtggaagtccggggctggaggtggaggtgtcggcgacgaggagcacctcaactaaagtggaataaaatggaggccagatgttcacgctggggaaatttagaggacgctgttaaccgtgagaagcgcagggaccgactaaaatggaataaaatgaaaggtgatggcaggacgactttcaaggaggcagcggggcgaagaggaccgaccaggcgcctaatttgttttttttttggcccattatgcacaaaacgaaatctggcgtgtttggttggatgtacaagactaaagtggaataaaatgcactgcacatgcagtgatgcctgggtctaaacgaacaagccctgaacgattcggtggattataataaatcggagaagattagagggtatgacatgtggggccagtgggccgccggctgggtgctcgatccgagaggattggaggggattaggattggaggggattgagggaacattcgatgtgatagtgataacatcatgtggttcagattatttgcacggttgcacggagggcgtcataatttgatatcgtgttctggttttgctgtcgccgagcagcggctgcaggagcggcccattatggtggaagggtaggattgtgggcgaggagatatgcagtggattatggtggaagggtgattttgtgcgagtcttgtatctaactaaaaagaaacggagagagattggaggggattgaggtggattggaggggattgaggtggaacggctcgacacggcttggatatactaaaatggaacaaaatgtctggatagtttgattgcacatggtgcaagcatgcaatcaatgaaactggcagagtagcgaagatgagtataaaatctgatggcacaaatatctgaaccaaacggggttaggctttaggtcgacggttgccgagcgtcagacgttgaggtgcatgcttctttgttacgagacttgtgagtcattttcatatgtgttaaggtggattaggataatttagggactaaaatggacgctgctgctgctgctcctgtgactaatcgcgattagtcgtcaccgccgtgatgatgtgcgcgagggctagtttggaaactcaaactaaagtggaataaaataaataatttagggactaaaatagaaactagagacgttagatataaacagctacaggcactttcggcattatataagttggattataaaatggcgagcttgagacgttttttttgtgaggggctgcagcaggggccgggcggtgggggccacggccacggccacggcgtcggttggattttgattggatgcacaatacatgtggattgaggtgacagtgtatatgggtgactcggtttgtgaggggctgcaaagagtgggcgttcccgaggaacgtcacggttctactcggagggtctggagagcctaagcatctcaagaactagagacgttagatctaaggttgaagagtagaatagagtattggaggggattgagggggaatggagtggattgagggggccgtggcaagagaattgaagaaaagagacgttagatctaaaatacggtccctggtgtgtgtggcttggattatggtggaagggtaagtaggaagttagtcagctgatttcggcgcgagagaggagaattatataagttggattatataacaagtaggctgatggggattgctagcagactgcttgcggcttcaggtgtaccccgagaccatcgtgtgggtgtgggtgtggcgccatcatcacctcattcctcataaggaatgaggtggtgatggagatctaacggaccaagaggccacccgggatcccgggaggatccccttgtcaccaaatcaacctgcttattttcggcggctancc

SEQ ID NO: 8428 - RNA, 28 nt, Artificial Sequence
  synthetic oligonucleotide
ggucuuagucgcauccuguagauggauc

SEQ ID NO: 8429 - RNA, 25 nt, Artificial Sequence
  synthetic oligonucleotide
  unsure (25)..(25): n = inverted deoxythymidine
augcacacugaugcugacaccugcn

What is claimed is:

1. A recombinant DNA construct comprising a microRNA consisting of the sequence set forth in SEQ ID NO:510 operably linked to at least one heterologous regulatory sequence, wherein said recombinant DNA construct when expressed in a plant cell produces the microRNA.

2. A plant, plant tissue, or a plant cell comprising in its genome the recombinant DNA construct of claim 1.

3. Transgenic seeds or transgenic progeny plants obtained from the plant of claim 2, wherein said transgenic seeds or transgenic progeny plants comprise the recombinant DNA construct.

4. A method for altering expression of a stably introduced nucleotide sequence in a plant comprising:

a) transforming a plant with the recombinant DNA construct of claim 1; and b) selecting a transformed plant which comprises the recombinant DNA construct of part (a) in its genome and which has altered expression of the stably introduced nucleotide sequence;

wherein the stably introduced nucleotide sequence comprises a sequence capable of hybridizing to the polynucleotide sequence set forth in SEQ ID NO:510.

* * * * *